United States Patent 9,464,333 (INTEIN-MODIFIED ENZYMES, THEIR PRODUCTION AND INDUSTRIAL APPLICATIONS) - sequence listing, part 2

SEQ ID NO: 2848 - DNA, 2418 bp, Artificial Sequence
  Synthetic Construct, AT-5 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgccaccatgggagcctatcgtggtcaggcggggggatgaggttcgggttacatcaatcggggagttcgtggattctttcctggagggcgagggcgggctggacatcggcgggctcggctactacaccctgtcgctcgatacccggacgctgaagccagtctggaggaggatccgcggcgttattaagcaccggatccgcggcaggctcctgagggtcaaggcctcaaagggccgctccatcgacctgacgggctctcattcaatctacaggattagcaggggcgggggcctggaggtggtcggctccagcgacctgaggccaggcgattctctcgtgacacctgcttcagtcgagctcccagagtccgccccttcgtctattaacgctgcgagggagctgtggagccggggggtggagggcatcttcgttgtggggctcccaggcgaggctgctgggtacaggggcgtcgagcggtcgcgcggctacgacgggggccacgctatccctctggagacgctcgtggagcgctacggcgattcggtctggtctctggtttcaggcgcgaagctcgctgtttcccggggggctgctggcgaccacccagtgcccgccaccattccgctggatacggggttctacctcctgctcggcttcatcgtgtccgctggcagcgtggacgtcgaggggggccatgttacagtgactctcggcccagggagggagggctacgtgggcgatgtcgttgaggctgtcaactccactgctccaggcgctggggtccgcatttcatccggggcgaggggcatggaggttaccatcaggagccgggtgctgtcggagctgctcgctagggtgttcggcgctgggccaggccctaatcgggacatcccctctattgtcttcagggccccgaagcccatgaagcgggttttcctgaagggcctctacgctgggggcggggtcttcgaccggagctcgggcagcctgatctacgccaccgattcccgcagcctgctcaacggcctcgctctgctcctgctcaatgtgggcgctggcgggtacaggatcgactcgggggattctggcagggctctggcgctcattgtggagaatgctggcaggctcgacgctatcggcgaggtcctggagcacctcggcttccatggcgggagggaggctgttcagggggtgggcgctctggagagggctacagctgggctcgctggccaggctactgtcgctgttcagaggccagctacccgcggcgggccaggcgtggacgtcgcgggggtgacgggcctggagcacctggaggctagcacagagttcgtctacgatctctctgtggagggggatgagaacttcttcgccgggctcgggtggattctcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2849 - DNA, 2148 bp, Artificial Sequence
  Synthetic Construct, AT-6 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctcctgagacactcgtgcataccgctgatgggcctcggcctattcgggatctccagcagggggatctcgttctgggcatcagcggccgctacagggaggttacccacaagttcgtgtacaaccagacggacgctatgctcgccatccgcgtcaagcacgccgttgagccaattgaggttacagctggccatcctttctacgccatcaggggcgtgccactggagcagtcgggggagcgcaccctcaggcagctggagtccggcaagcggagcccagagtggatcgacgctggcgagctggagaggggggattacatggcccaggtcatcccatctgaggtggtccctgtcgcgggcttcgacgaggacgatgctcgcctctacgggatcctcctgggcgatgggcatctcagcaagaatggcctgcagtggggcgtctcggggcacccacagagggacgggcacatggatttcgttagggcgtacctgtccgctcggggcatccacttctgggagaccgcgagggacgagacgtacgggcagattcattgggctagcggcaggggggtccgcagggatgctaccacgggcaggatcacaggcgctggggctgcgactctccctttcgagcacgccgacctgtacgatgagcagggccggaagcgcatcgctaggcgcttctcacatctcccaaggcagcagtccctcgctctgatcaggtcgctcctggagtctgacggcggggtgtctcgcggcaaggagatctacttcacaaacacttcaaggcccctcattgagggcctgaggtaccagctcctgaggctgggcgtgccaaccgctgggcagtacagggagaggaggcaggaccacgtcggccagagggctgatgggtcgccaatcaggttcgagggcgtgtgcaaggcgtacgacctcaggattccggctgttccagaggtggctcagctggtcggctgccagccaatcgccaagcggaattggattacgtggcagggctgcgtctactccaggatccgggatgttcagccgattgcggtgaagcccttcgtcttcgatctcaaggtggagggggatgagagctacatgactacttccgggctcgctcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2850 - DNA, 2478 bp, Artificial Sequence
  Synthetic Construct, AT-7 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcgggggatactgaggtcgttctcgggaatggcatggacgtggttctgctgacggatctcgtggacggggcgtgcgtttcgacaatcgagccaaggactggcgtggtcagcccatcgctcatcgaccattacttcgccaaggatgcgacccgcgtcctcaagatcacgctggacgatggcagggttattaaggctgacccagagcaccctctgttcgctgctaaggtggatgagaccacgcgcggcctcaccgggcagtggctgagggtggaggagctcacggtcggccaccatgctctcctggtgtcgccacagcaggcttactgcacctctgagcagtggacactcactctgtcagagaaggaggtctgcaccgcttccacggctcagctcgctaagcagctgtccgagatcggcctggtcggggttccgattcccctctctaaggtgaagtcagctgccaggctgttcggcctcgtcctgtccgctggcgacttcagcgggaagctctacgtggagaaggacgaggatgttacagccgtgaacagcgacctcactgcgctgggcttctcgccagctcactgggtccggtaccaggacgatcagcagaagtggttcaagtgcgacgattcgaacggcaaggcgatctgcattaccctggtccctacggctaatgctctcctgcagaccctcggggctcacgacgctgagaagcagcatcggtactgcctcctgccaaagtggctcctggatgcccctacgtccatcaagagggagttcctcggcgctctgttcggcgggaacggggcccacatcacaatttcgtgcaatgagggcaagtgggagccgactatgtctgcgctcacacagcacactgacgctgatcatctggagagcacagttgtgtacctcaagcaggttgccactctcctgggcatgctgaacatctgctccagcgtgtcgtctgagaagcacattacagccgagaagactgggtacgcggtccacctgcatgttgacaacacggcggagaatctcgttcggttctacgagcaagtgggctaccgctactgcttcaataagacatcccagtcatccgcccccgtgcagtggatcaaggggtctctgttcttcattgagcagcaccgctcaaagtgccagcatgctttcgagctcctgcacaccggcctcgggacgaaggctgctgtctccgccgagatcaacatgccacaccataatcctagccacatgctgaacgttaaggagatcccgaccgctcccgccgacgagtacatcacgtggattgagttcaaggatcgctacgtgcataaggagtccccgcggttcgtgtgggtcaccatccacagcattgaggaggcgcccgctgagaggctctacgacttcaatacggtttcgcagaatcatagcttcttcgccaacagcatcgtctctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2851 - DNA, 2271 bp, Artificial Sequence
  Synthetic Construct, AT-8 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgggcgggatacccctctcctcatggcggacggcactactaagttcgttcaggacattaaggctctggatcagctcatgggcgacgattgcacgccgcgcatcgtccaggagaggtctctcgttcacgagtcaggggctctgtacagggtggtccccaagaacgccaatggccacgacgcgttcgtgtgcaacaaggagcatatcctcgtgatggtcaatgttaagcagccgtgggtcagccagacggttatcgacggcgtggatcagttccatgtctcggaggttgtgtgcatcgggaacattccgacagtgcgctccagcggcaatttcgcttctgctgtcgaggctacgaaggctctgccagcttggacactcctgatctgggagattagcgtgctggagtacctggcggtcgacgctgatctcaggcagcacttcatgatctacaagccagctggcgggattgagtacccaaccacgacaaacctggacatcgtgcagcacttcggcgccgagtcggttcccaacctggagcatgccgtgatgtggtgcatcggcctgtggattctcctgggggacgtcgatacagccggcaacccagttctcatcctgagcggcattgaccacctccatcctctgatcaagactctccactcgcattctcagaagctgtcaatttccttcaccaaccagctcgacgagggggtcgctgatatcagcaagccaaccatcattgccctcggcgacaagttcgggctcctgttcaagtccctgggcatcgagagcgctgagtgcattcctgatgccctcctgaggtcgtctaagctccacagggctgctctcctggctggcctggtggaggggagcaacgctttctcgatcgtcaaggacactccaaagcattgggatatttcctgcaagaacaatatgatcttcgagaatattaagaggctctcatccagcctcggcctgtgcgttgacacggtgacaccagcgactatcacccagcaggtgtccgtcaagacgctgcagatccggatttcgggccctcgcatgcactacgtgtctgagctcatcagcaacgactcgctgaagactacctctgtcgtttcaatcgattcctggctgaacgtcaagtcaaatgcctgcgagttcgagatcgagtccattggctgcggggagtacttcggcttcacagttatggggccaaactcaaggttcctcctcggggatttcacagtcacacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2852 - DNA, 2169 bp, Artificial Sequence
  Synthetic Construct, AT-9 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacgggggagacgctgctgctgacggagaatggctacgagaaggccgctgatctctacaagaagcagaacaatctgaaggttgtgatcgacaacaggacaaaggacttcgctgtggatagcaagggcaccacgatcgtcgacgctattccaatgcagctgacgaagaaggatgccgagatcttcaaggtcaagaccaagcagggctacgagattcgcgcgacggagtggcacaagttctacgttaagagggacggcgagatccagaagctgcagctcaaccagctgaagaccggggataagctcctggtccagtccgctgagggcgcttacgggaagatccatgagcccgacctcgcctacattatgggcatcattgcgggcgatgggaccatcacggagaagaccgccaagatctacctctacgacaacaagaaggtgctggagcagaaggttacggatgcggtgcacaggatcattcacaagcataaggtcgaccgggcttacaagcataatacatcactcctgccaactttcaacatggcgaatcctgagaagcaggacctcctgtacatgaactccacagttctgttcgatatcctcaagaagttcggcatgaataaggagcgcaagactagggtcccggagttcattttccaggccaacaaggagacacaggccgcgtacctgagcggcctcttccagactgacgggtgcgtgaacgcgaatcacaaggctaaggccctgaccatcgagctcacgtccattcattacgagagcctgcaggatgttcagaagctcctgctcaatatgggcgtgtacacaactatctactcgaacaataagcggtctcaggagctgctcccagacgggaagggcgggtcgaagctctacaacgtcaagcccacccacaagatctcaattcaggatcgcaactcccgcgagctgttcatgagcatcgtcgagctcaaggactacgatgtttacaagttcaacctgctcacagagactctccagccgaagtcgcgcaagcccaagcacgacttcacggccgagatcatttctatcgaggaggacggcgtggaggatgtctacgatactactcaggaggattaccactctctcatcttcaatggcatcgttacgggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2853 - DNA, 2124 bp, Artificial Sequence
  Synthetic Construct, AT-10 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccgctgacacactcatcgctactgacagggggctggagaggatcggcaacatcgtgggggagtctaggggcatcaagtctattgacggcaagctccactgggtcgagaacatcttcccgacagggactaagcccgtttaccagctgaggaccaagtctggctaccagctgaagctcaccggggatcatgtggtcttcacggagaataggggcgacgtcaaggcttgcgagctgaggaaggacgatatggtccggctcgttggcgctccattcgggaaggagaccacgggctccacagatatcgcccagctcattgggctcctgactggcgacgggtgcatcacaactgccaacgagattgctgcttcgggcgagcagaggaggaccgcgttcctgacggtttctaaggctgagcaggagattgcggagtgggctaaccagttcatcaatacgctgaggccggagctcggcgagcacaataagtcggggtctgtgaccgagacggccaccacggcgcgggttgctgtgggctccccacgcatcctcaagcagttcgaggcgttcgctgttctggataagggcagcgtgcataagctcttcacagacaaggtgttccagctggctcagtcggagcaggctgctctcctgaggggcctgttcacagctgacgggactgtcgccaactactccgataagtcccagtacatcgctctggacgctacgagcctggagctcctgcagcaggtccagctcctgctcttcaacttcggcatcaagtccaagatctacgagaataggagggtgggcgagctcgtctccctgctcccagacgggaagggcgggatcaaggagtaccctgtgcagcagatgcacagcctcaggatctcgcggtccagccgcattctgttcgagcagcagatcggcttcatggccgagtcgaagaagtacgaggccctggcggagctcaaccgcacagtgtccacttacagggacagcgcgtacgatgctgtcgcctctctgacctactcaggcgaggaggccgttttcgatctcacggagccggagacggatcatttcattgctaatggcattggggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2854 - DNA, 1842 bp, Artificial Sequence
  Synthetic Construct, AT-11 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctccatggggattcgctcatcgtgacagatcatgggctcgttcctatgcgggaggtcgtgaatcatcgccagcggctgcaggtctcagacggcgagaggcagcagacagtgtacgactggaaccggttcgccgattacccaaccgtcacgatgaggaccagggcgggcttcacactgactgggtcccacaatcatcgcatcatgctcgctgacggcacctggaggaggctggacgagctccagatcggggatcgggtgcgcattgctggcgggaccgagctgtgggctacggagccagctctcctgaggtgcaggaggccgctgcccagggtcctcgttaccgctggcgccccggccgcgaccacgtccagcccccacaggcgggggtacaggagggctgctgctgtggtcgttgacgagaagctcgctgctgctatcggcaggcgctgcgttacgcatgctgaccagcaggccctggatgcgattaggaggtcgccaaggcctcaggtggtcgcgttcctccgcgctttctgccagggcgctgggcagtcggtcgcttctggcctgaccctcacgtgcgctgacgctgatctggccacaactgtgcagctcctgctcacaaacctgggcgtcctcgcgcacaggactgacaccacggttcggattgataatggcgacgatctggagagggcttacacaactctcgccacaccgactggctggaccgacgaggttgtggcgctggagcatgggacggctgatgtctacgacatttctgttactgctactcatcgctacgctgctcagggcttcatcaaccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2855 - DNA, 1452 bp, Artificial Sequence
  Synthetic Construct, AT-12 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgacaggggacactctcatctgcctcgctgacgggcgccgcgttcctattcaggatctcgtggggcattcgccggaggttattgcggtcgacgataagggccgcctcgtttgcgctaagtcagaggtcatctggaaggtcggcgagcggtccgttttcgagatcaagctggcttccgggaggagcattaaggctaccgctgagcacaggctcctggcgttcaagggctggaggcatgttaaggacttcaaagtgggggataggctcgctattgctcaccaggtcccagagccagacaggctcctgcagcattgccagtcggacctgttctgggataggatcgtgtcgattgaggagaaggggtctgaggaggtctacgatctcacagttccaaagtacgcttcttggctcgcggatggggttgtttcacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2856 - DNA, 2382 bp, Artificial Sequence
  Synthetic Construct, AT-13 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacatcggaccatacggttctcactacaaggggctggattcctatcgctgacgttactctggatgacaaggtcgctgttctcgacaacaatacgggcgagatgtcctaccagaacccacagaaggtccacaagtacgactacgagggccctatgtacgaggttaagactgccggggtcgatctgttcgttaccccaaaccataggatgtatgtgaataccacgaacaatacaactaaccagaattacaacctcgttgaggcttccagcatcttcggcaagaaggtgcggtacaagaacgacgcgatctggaataagaccgattaccagttcattctcccggagacagccactctgaccgggcacacgaacaagatctcgtctacaccggcgattcagcccgagatgaacgcttggctcacgttcttcggcctgtggatcgcgaacgggcataccacgaagattgccgagaagacagcggagaacaatcagcagaagcagcgctacaaggtcatcctgacgcaggtgaaggaggacgtctgcgatatcattgagcagacactcaacaagctgggcttcaatttcatcaggtccgggaaggactacacgattgagaacaagcagctctggagctacctgaatccgttcgacaacggcgccctcaataagtacctgcccgattgggtctgggagctctcatcccagcagtgcaagatcctcctgaacagcctctgcctgggcaattgcctgttcactaagaacgacgataccctccactacttctccaccagcgagaggttcgctaacgacgtgtcgcgcctcgctctgcatgctggcacaacttctactatccagctggaggccgcgccatcaaacctgtacgataccatcattgggctccctgttgaagtgaataccacgctgtggcgggtcatcattaaccagagctcgttctactcgtactctactgacaagtcttcagccctcaacctgagcaacaatgttgcgtgctacgtgaacgcgcagagcgctctcacactggagcagaactcgcagaagatcaataagaacactctcgtcctgaccaagaacaatgttaagtcacagacgatgcactcccagagggctgagagggtggacacggctctcctgacacagaaggagctcgataattcgctgaaccatgagatcctgattaataagaacccgggcacctctcagctggagtgcgtggtcaatcccgaggtcaacaatacgtccacaaacgataggttcgtgtactacaaggggccggtctactgcctcactgggcctaacaatgttttctacgttcagaggaatggcaaggctgtttggactggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2857 - DNA, 2049 bp, Artificial Sequence
  Synthetic Construct, AT-14 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacgggggacactctcgttttcactgacaaggggctgattgaggctcgcaagctggaggtcggcatgaaggtctggtcgggggacggctggaacgagatcaaggaggtcattaacaatggggtgaagccggtcctgaagctcaagctgaagaccggcctggagatcaaggttacggaggagcacaagatcttcacaggcgaggggtggaaggaggccaaggacctcaaggttggcgataagctctacctgccggtgtcttaccccgagctggacttccccgtcaaggaggagaacgatttctacgagttcctcggctacttcctgggcgacgggtcactctccgttagcaaccacgtgtccctgcatgtcgggaatgacaaggagctcgcgctgtacttcaaggagaaggttgagaagtacgctggcgctgcttacctgatcgagagggacgggcagtacatcattgatgtgcatcgcaaggagttcgccgagaagatcaagaagattttcggcatcgagattaccgactcgaaggagaaggatatcccgtccagcctcctggcggtgaactccgaggctatgaaggctctcctgaggggcctcttctcggctgacgggtctgtctacgatgctaatggctctatcacagttgccctgtcgtctacttcatacccactcctgcggaaggtccagatcctcctgctctcactcggcattccttccacactgactggggagaaggaccaggatgtgaagatcattaagggcaacgagtacgagaccctcccaacgtaccgcctgatcattagcggggagagggcctcgctcttcttcaataagatcggcctgattggggagaagaagaagaagttcctggagctgatggcgggcaagaccacgtactccaccctcaacaatcacctgtaccaggagatcgtgagcattgagcccgctggcgaggaggaggtcttcgatattacagctccaccaaagtacacttggattaccaatggcattctctctctggatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2858 - DNA, 1419 bp, Artificial Sequence
  Synthetic Construct, AT-15 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgtggcgggcactatgatcctgacagtcgcggggctggtcgctattgagaatattaaggcgggggacaaggtcatcgctactaacccggagacattcgaggtggctgagaagaccgtcctggagacctacgtgcgcgagaccacggagctcctgcacctgacgatcaatggcgacgtcattaagacaactttcgagcatctcttctacgccaaggatgtcgggttcgttgaggcgaaggagctgcaggtcggcgacaagctcctggattccaaggggaacgtgctcgtggtcgaggacaagaagatcaagattaccgatgagcccgttaaggtgtacaatttccaggttgatgacttccacacataccacgttgggtgcaatggggttctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2859 - DNA, 2013 bp, Artificial Sequence
  Synthetic Construct, AT-16 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcccagctggctctggacactcctattcctacgcctgacgggtggacaactatgggggagatcaaggcgggggacaaggttatcgatgagaagggcaggccgtgcaatgtggtcgctatctccgagattgacgatacagagcaggcctacaagatcaacttccgggacggcactagcattgtcgccggggagcgccacctctggaaggttcaggtgaccaacaatggcaggagggagaagctcctgaccacgggggagatgtaccagaagcagttcaagaccaagtcgaaggagaatcgcgcgctcttcaggatcccaattgccgacgcgttcatcctccctgagaacaagctgccgattgatccctacctgttcggctactggatcggcaacgggaatgctgtgaagccggagatcacagtcatgcgcgacgatgtcgacgaggttatcaagaacattccctacaagctccataataggtacaagcaggagggcaactcagacatcctggtttacaaggagctcaagtccattctggtgaagaacttcagggagaagcggatcccaattgagtacctcagggcttctgctcagcagcggaagcgcctcctgcagggcctgatcgactcagatgggtgcgtctccacagccaagagccaggcgatctacgttactattctcttcgagctggccaaggacgtgcaggatctcctgtggagcctcggcatcaagaacacactgaagactgctccatcggctcgctacggcatcgagaccggggagatctgctacctcattaagttcacggcgttcaatgacctggaggtgagcggcctcgataggaagctgaagagggggcgggagcgcaacatcaagacccggtcgcacttccattacatcaagtctattgagaagaccggcaagacgaagatgcgctgcatccaggttgattctccaagcaggctctacctcgctggcaagtctatgattccaacacataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2860 - DNA, 2022 bp, Artificial Sequence
  Synthetic Construct, AT-17 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggcgggggacactaagattctcacatcatcgggctaccatcccatcaaggacatggagggcaagcaggttcgggtttggaatggctacgagttctcggagacaatcgttcacaagactggggtgaaccagaagctcattatggtgtctctggacgatggcaccgagctcaggtgcacgccgtaccataagttctacatcgagaccgggtcgcggccagctgacaagtctcgggtcatggaggttcgcgctggcgacctggagaagggggaccgcatcattaggttcgagctgccgacaatcactgtcggcgagaccacgatgagcgacaaggaggcctacacaaagggcttcttctctgcggatgggtgcgtcattaagtcaaagtacggcgaggatgagtacaggatctcggttaagcgggaggacaagattgaggctctgacgaagtatgtggatgtgatcaagtcccacacaaaccggttccgcactcatttctacgtgccagactacgtccagaataagttcgaggtccctatcaactcaatggttaatgagaagatttcctggctcgccggcttcatggacggcgatgggtgcgttatccgctacaaggacattgagaacatgcaggcggtgtccatcaataagagcttcctgcaggatattaggctcatgctgcagaccatcggcattcactccacgatcaacaagttcatgccgaatcgcgtgatgaagatgcccgatggcaggggcgggaccgacatgtacaacggggctgagagctggaggctccagatcgactcggagggcgtccgcaagctcttcgctctggggttcacgccgcgcaggctgaagatgaacggctccaggaagcggcaccataagaccaataagttcacgcgcgtggtcagcgtgacagaccatggcgatgtcgaggacacttactgcttcaatgagccaaagaggcacatgggggtcttcaacggggtcattacggggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2861 - DNA, 2196 bp, Artificial Sequence
  Synthetic Construct, AT-18 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgatggcaagacaaagattctcacaaatcaggggttcatgacgctgcggcaggtttacgagcagggctacgaggggctctcaacgctgtcactcaacaccaagacgcacaagatcgagtggaagccaattctggacaccatgaagcgccagtccgagatgatcgatatttccgttagccagactggcaggatcaccgacaacacgctgcggctcacccctgatcataagatggtcaatctcaggggcgggaagtacacaaagactgagatccaggacctcctgaagcagcaggagatgctgactgtggcccagaccatcccgagcctcggcaacaataagcaccaggaggcggacctggcttacttcctcggcgggatcattacggatggctcgatctacacatccagcactcggggggaggtccagttcatccagaaggacgttccggagaagcaggctttcatttcgaagatgaacgatctggccaattcgctctacggcaagtctttcacggcgcacatcaagcccgtgtcgtcttcatacattaggggccagaaggtcacggggcaggctacagcgtacaggctgcattccaaggctatcgcctacgacgtcaaggagcgcgagaacaatattacacagctcctgctggagaacgaggctgagctgtcttaccatttcctcggcggcgtgatcgacggcgatgggtgctaccacaagaacaggctccatatctacatttcagaggagaatctgctccaggccgtcatcattgcgtgcctgaagatgaatactgtgccgcaggtcaccaagaaccggaatatctaccacctccagattgtggagaagctggaggtcatcctccggtacacccagcgcgtcaagggcgaggttacccccaggacgatccagacacggttcttcgcgacgcgccagctgttcgagaaccaggagacaggccagatcaagctccggcaggacaacaattgcctgatttctgataagcagctccgcgagatgggcgagttcgaggagctgatcgacggggatactcgcatgcagagggttattcaagtgggcgagaagagcgacggggatgtttacaacatcaccgtggcggagcatcataactacgtcgttttcacagccaagtacacaccagtcgtcgtttgcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2862 - DNA, 2055 bp, Artificial Sequence
  Synthetic Construct, AT-19 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgccggagacaaagatcctcacagacagggggcagatcgccatcgctgacgtcgcgggggagaaggtcaatatttggaacgggtcggagtggtctgaggttctcgtgaagaagacaggcgagaaccagccgctcctgaaggtgcacttctcaaatggcgagtccctggactgcacttactaccacaagttccatgtccaggagaactacaaggggaaggtcaagatcgttgaggctaaggacctccaggagggcgataagctgattaagtaccggctcccactggtggagtccgagaatgacatcgatttcccttacgcctacaccagcggcttcttctcgggcgacgggtctcatgatggcatggggaagccggagattgacctctacggcgagaagaaggagctcctgcccttcgtcacggttaggaacaagtactacggcgggtcatacggcgacaagtcctggcgcatcgagagggatgaggtggccgtctacgacgatgttaaccaggaccggatcgtgtgcaagctcccgctggatattcccgcgaagttcacagttcccgtgaatggctacactatccagagcaggctggagtggctggctggcctcctggacgcggatgggacagtcgctaggaacggcgacaatgagagcctgcaggttgcgtcgacccaccagcagttcctcctggacatccgcctcatgctgcagacgctcggcgtcgactctaaggtggtcaagatggatgagatggggtacaggtcgctgccagacggcaagggcgggtaccaggattacttctgccaggcgaagtaccgcctcctgatttccagcaacggcctcttccagctgggcgagctcgggctgaagaccaacaggctccagtggaatctgagggagcctcagagggaggcttcccagttcatcagggtggagaaggtcgagctcacctgccggtacgacgatacgtactgcttctcagagccaaagaggcatctcggcatgttcaatggcatcctcacagggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2863 - DNA, 2835 bp, Artificial Sequence
  Synthetic Construct, AT-20 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcttcggacactctcgttcgcacatcggagggggacaagccagtcgctgaggtcgctatcggggactacctgctggacgctgaggacaagccagtcctctgcatgggcgctaacccttcccagaccgggcgcatgaaggagatcgcttaccaggacttcgattcgaagaagagggtgtctttcaagtgcacaccggaccaccacctggagctgacactcactgattccactccctccctcagcggcaagtcagtcacctggttctccaggtgcacgggggctcacctcagcgaggaggtgtcggaggtctacctggacaacatggtttcgatcttctacaatgatctggttgactcgacggattctgcggtggacaaggattccattcacgaggccgtggacctggcgctggaggatcactaccataggggcaactctgaccagtactcaatccatctcaatgagtacatcagccggattgccgataaggagctgcagaacgagccggagttcatccgggagtgcattcacgacgccgcgaatcgcttcgtcatcacctccagcggcaacaggaatattaagtcggagtctttcgacgataagctcctgctctcacgctccaggtcgtctacagctgacagcgattcggactacgtgatcactgacgcctccgtccactctcattcaaacaattcatccgtctacctcgcctcaccagactccatgatccctgatggcgctgccaaccgcttcgagaatattgcgtccaagctgaaggagccagtgtgcaactgcggcgggatccggaagattttccgcagcttcggcaccacggaggacgctgagctcgcttactccctgctcctgagcgagcactactacaggctggacccacggttcgtcacagatggctacactttccaggcctcggttgagcagtacgagaacatgtgctctcaggaggtgcagaatatgcacctgaagctctaccgctcacctctcaagttcgtggagagggagcataactccgctgagctgccagtcgacccatacttcctgggcctctggctgggcgatggggacagctcggggacaactatcatgaccacggatcgggagattgtggtctggctcaactcctacgtcgagcgcctgaaccagaataagccggagggctgcttccccctcaagctgaccgagcagctgatctacggcgctgggcacacgtccaagagcgggcatacaactaaggtcgacgttaggaattacaagatctcttcaggcgatgctttcgtgcggtcggggacatactggaacccgattttcgacggcctcaagaagctggggctcctgaacaataagagcgctggcatcccccaggagtacatgaactctgacgagcagaataggctctcagttattgccggcctgatggattccgacgggtgctacgtgaagagccacaacacctaccgcttcacccagctcacggaggaccataagaagatcgtctacgatctgaaggagctcgccctgagctgcggcattaacaccacgggggtcgagctctcggttaagccgctgggcttcaataagcacaagcattctaccgagtatgtggtgtacctcggcaacgggagccagaagttccaggagctcctgctcctgccacggaagaagatggagatcagcaagaagcacgtgtcgctggacgcgcgccctttcacggttagcgacgtggaggatggcgagttccgggctattgaggtttcagggggggttttccagctcgctaataggctcgtggttgctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2864 - DNA, 1896 bp, Artificial Sequence
  Synthetic Construct, AT-21 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccagccatacgacgctctcgtttcaacgccatcggggctcgttcctatcggggctctcgtggagacagacgcggtcggcatgaaggtgttcgatgcgcacggcctcacacaggtcattgctactaagagcaacggggttaaggacgtgctgaggatctggacccgcgcgggccacgctctcgacgtcacggccgatcatctggtttggaggtccacaagcgctggcgctggggctttcgtgccagctggcgctctcagggctggggacacactggagtggcataggactattgctccaggcgagggggagatcacgagccgcgagattgctgaggctgctctcgctggcaggctgcaggctgatggcttcgtcgggcgctacgctgggaccaatgcttcgctcacgatcgaggcgatgaccgttccaacgaggctctacgacgctccactgccagtggtcgctgcctacctcaggtcactgttccaggctgatggctacgtctcgcgcagggagaggtctaccctcatcggcctggacatgatttccgaggggctgatcaggggcgttcaggggctcctggctaggttcggcatcttcgccagggtgcggagggaggctgatccacgccctgacaggcacgatctctggtccctgggcattcagaacgctggggacaggcggaccttcgccgatgagatcggcttcctcgacccagtgaaggcggctaagctggaggcttccttcgaccagccaggccaggctgctaagcctgtcaagaggctccagatcgagaggattgagccgaggggcccgatgcccgtctacgacattcagacagattccggggagtacctctctgctgggctcagggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2865 - DNA, 2352 bp, Artificial Sequence
  Synthetic Construct, AT-22 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggtcgcgggcactgaggtcacagacgctgagacaggggcggtcgttacggtcggggagctcttcgagtcgcggagggcggtcacagtccacgctctcggcgctgacagcaagctgaggccaaggcctgttactgatgtggtctggaacgggcgcaagagggtgtaccgcctcaccacggagctgggcaagtcgatcacagccactgacaaccatcctttccgcgtgctggatggctggaagaatctcggggagctgaagccaggcgacaggatcgctgctccaaggaggctggcggtcccttcggctggcacctggccgcagcacgagattgttgcgctcgctgggctcctgtctgagggcaacacgtgccatcccacaactctctacttctacgggaatgaccgggttctgatcgacgatttcgcgcgggcaattggccagttccccgatacagtcgccaaggtttacgctaggccaaacaggaggaacctggaggtgcgcgctaacacaggcagggacactcgcctgaagtcaagggcggagagggatgctgctgtggctctcctggctccaccaacgaggtccggcgctttcgtctgggctcagaggctcggcatcctggggaagaccgctacggagaagttcgtgcctcacgacgtcttccggctctgcgacagcgatctggagctcttcctgggcaggctgtgggctggcgacgggttcattgctaatgataccctcaaggtcccgttctacgctacgtccagcaggaggctcgctcaggacgtgcagcacctcctgctcaggctgggcatcgtcgggaggattcatgagaagcagttcaagtacaagggcgggctcaagcccggcttcacagtgcacctgatcggcgacggggctgctgaggccttcctcgataggattgctccacactgcctggggagggagcatgctgtcactatcctcagggagcatgttgctaccacggcgaggggcctcacctccaaggacacggttccgctggaggtgcgcgcttgggtcgacgatgggaggagggcgaggggcctcacctgggacgagctggagcagcagtcggatgtctctacacaggagttctacggcactccagctccaggcaagaaggggttccggagggctacgatcgctaagctcgctgcgttcttcggctcacagaggctggctgctgttgctgactccgatgtgttctgggacagggttgtgagcattgagtacgcgggcgtgcaggatacctacgatctcacagtggatgaggatcataatttcgttgctaatgggctcatcgttcacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2866 - DNA, 1875 bp, Artificial Sequence
  Synthetic Construct, AT-23 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccagcctgcggggacacaggtcgctaaggttattaaggaggggaggtggagggaggattcggttattgagcaggttcctattgagtcactccagccaggcgacagggtggtctccttcgggaacgcgaagatctaccgcaggggccgcgctgtgacagggattacttcccggcgccacacaggcaatctgcatagggtcgaggttggggagttccgcaccagggccacgccagagcacaggttcaccgtccggttcgacccagctaggcctaaggctggcctcctgtacctcatgaggaggggcgataggtggagggtgggcgtctgcgggatgttcaactcgcgcggcttcggggtttccgtgcggctgagccaggagaggggcgacgctgcttgggtgctcggggccttcgcgacactgactgaggctaggatcgccgagcaggttgtgagctgccggtacggcattccaaccacggtctgggagaccggcaggaatcctggggcttcgtgggctcagagggaccaggctggcatcgatgccatctaccagaggctcggcgtcgataggatccgggctggggttgacaggctcctgagggatcacggcctctctgctgggctgccactcctggctgccaacgagcccggcaatttctcgtgcaggcagtctaggcaggtggctgcttgcaacctggtgccaggcgtcatgcaggtcccagttccaacggctggcgagaggttcgagtggagggacctcaccgctacgagcttcgagagggttcatgatctggaggtgtggagcatggatgtggagagggataagcattacgttgcggatggcatcgttgtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2867 - DNA, 2250 bp, Artificial Sequence
  Synthetic Construct, AT-24 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctgcggggacgctgctgcatactgagcagggctacgttccggtggagcaggtcgtggcgggggtcgggacaagggtttgcacacaccagggcttccggaacatctctgagcgcttcgataatggggaggccgaggttttcagggtgaccacgcggaagggctactccgtggaggtcactgcgaaccacaagatggctcgcctcgacgagaatggcgatctcctgctcgacgagctctcacatctgcaagtgggcgacaacctgctcctgctcctggggtccaatccggtgaccgagaaggtccggctgcagtgcatcccagctggctaccgctccagcatcgagattgctcagccgcccgagctcgatgagcagctggcttacctcctgggctacgcctacggcgacgggtgcgtcggcaggggggctacatacaactacctcagcctggctgtgtcgcacacttacccgaatgtccgcgaccagctcgccgcgatcattagggagaagttcggcctgacaactaagatctactcaggctccggggcggtttggaacctcctggtgcattccgccaatctcctggattggctcaaggcgaacggcctcctgaagcagaaggctgcggacctcgccatgccagaggcgattctgcgctcgccttcgtctgtggtcggcgctttcctgtctgggtacttcgacgctgatggctgcgtgaggggcgggaagggcgggtacgggttcgattgcacgagcaaggctttcgtcggcgctgttcagctcctgctcctggccgaggggatcgtgtccaacctccacaccacggaccggagccgccagggctggcgcacaatctacaggctcaatgtctgcggcaccgagttcaagcgcaggttccagacgctgtgctgcaggtctgcgaaggttgtgcattcaccaatggtgctcggcagggatgggaccggcgggtacccacctgctctggttaggggcgcttcgtaccagagggtcgttgctgtcggcgggaagcacctcctgtacacggcgctcctgaaggtcatcgagaagacaaggactgctggcaagcaggctctcgctgagagcctgtgccagcatgtcaactacttcccggaccccatcgtcgcgattgagtcggttggcacgcagagggtttacgatattgaggtggagggcatgcatctgctcggcaatggcatctacacaagcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2868 - DNA, 2490 bp, Artificial Sequence
  Synthetic Construct, AT-25 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcctacgacgcggagatcgttcaggctgacgggggggttaagactattgagcagatcgttagggagcggcgggcgcatctcgctacggtcggcgctgactggaggctgacatggactgagccgtgcgattacgttgacgatggccacaagcccgtcttcgaggttaccacgcgcctcgggcgcaggatcgagacaactctgacacacccgttcctcactgtccatggctggcagaggctggaggacctcgctgagggcgatgctatcggggtcccaaggcagctgccagttttcggccaggagcccattagggactgcgaggtgaggctcctgggccacctgatcggggatggcgggctcaccggctcgccacccaggctgacgtctgggcaggaggcgatgacagctgacttcctggaggctgtggatgctttcggcggggtcgaggctaagccaatcagggcgtcccggaggacgcagagctgggtggtcgttggcgctgctcaggcccgcgctgctgctaggtccagcttcgcttcactggtcgacgccctcattaggaggtcccctctcaccggcagggctatcgctaggaacctgggggtggcgccagctaccctcacgtactggaggcagggcgtgaatgtccctgacgctgctatggttgggctcctggctggcgagctgggggttgatgtgggcgagctcaggccagagcctgtggctcgcaggaacgaccgcaatccactgcaggcttggctcgataggctgggcctcgctgggaagtccgctcacgagaagactgtgccagactgcgtcttccggctgcctcgcgagcagctcgctaggttcctgaaccggctcttctcgtctgacgggtgggtgacacatctggctagcggccaggggcagattggctacaccacggtctcggaggctctcgctaggcagatccagcacctcctgctccggttcggcgttctggctaagctcaggcataggtccgtgcgctaccaggacggcaggaggccagcctggcagctggatattactcacgcggagagcatcctcaccttcgctgagcagatcggcattctggggaaggagcagcggctcgcctctgttgctgcttcagtgcgcggcaggaggaggcagtcgcacacggaccatatcccctgcgagatttggcagttcatcgatagggccaggggcgagtggacatgggctgagctggctaggagggctggggtcgcttcatccaatatccacgcctacaggaggggcatgtctaggcagaggctggctgctttcgctgacgctctcggctcaagggagctgaggcagctcgcgagctcggacctgtactgggatcggatcgcctccattcgcccgctcggccataagcaggtgtacgatctcactattccagagactcataacttcattgctaatgatgtttgcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2869 - DNA, 2445 bp, Artificial Sequence
  Synthetic Construct, AT-26 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgcatggggatacaagggttactctcgctgatgggcatgagcggcctattcgggaggtcgtggagtcaaatctggatgatccgaagccagtcgacgatggggtttgggataccgtggacttcgatgtcccttctctgcagtcagacggcacagttgcgactcagaacgctacgaaagtgtggaagcggaaggcgccggagacactctaccgcatcaggaccgctacgggcagggagctggatgtcacaccatcacaccctctcttcgttcagtccgacgggaggttccaggctaggaaggctgaggagctggagtctggcacccatgttgctgtgcccaggaaggtttcaactaacgcctgcaatgagctcgacgtcaccttccggcagtctcaggcccacaaccgcatcgacctcgatctgccaccacagtggacgccagagctcgctaggctgatcgggtacattgttgcggagggctacgtggagcagaggcctgataatacgggctacgtgtccatcacaaacaatgaccgggaggtgctggacgatgccaagagcgtcctggagactctcaacctgaatgtcaccgagcgctccagccacgaggggaagacggcgagggagctcctgtgcagcgctggcgagttcgtgtccttcctcgccagcctggacgagacactcctgcagtcgtctgctgagaggagggtcccgcaggatattatgagggcttccgacaacgtggtcaccgggttcattcggggctacatcgagggggagggccatgtgtcaacgtcccagcgcgagatcacagtcgcgagcatgtcgaagccgctcctggaggacgtcaggaccctcctggttacgcagggcattacagcccagctgcagccccggaacaatgggtcctacaggctcaggatctccggccagagcttccacgactacgcggagcagatcggcttcattactgcccgcaagaccgaggcttgcaggcagttcgaggggacgcatggcaacacaaatctggacattgtgccgaacctgggcccagagctcaggcgcatccgcgaggctctcgggctgactcagagcgagtgcggcctcccaaggtcgacctaccagcactacgagaggggcaggaggaatccctcgcgggattctctggagtcagtgctcgacgctttcgagactaggctggccgagatgaacaatgacactccaatttcggataccgctaggtctgacggcgggggcacgggctcgctcaggcaggatctcaacgggctggctgctctcgtggagggcgacatcgcctgggatcgcatcgagtccattgagcctatcgagcatgacgagaagtgggtctacgatctggagattgagggcacacataactacctcacaaatggggtcgtctctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2870 - DNA, 2628 bp, Artificial Sequence
  Synthetic Construct, AT-27 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgactgcggattcggacgttctcgttaggtcggagaatggggatattgagcgccagacggtggactctctcttctcggacgggcaggtggtcctcgcggacggcgataccgacatcgctgtttctaaggagacaccgactgtgctctcactggacgaggcgactgagagggtgagcgagcaggagtcgaccctcgtctctgagaggccactgagggacgatgagagcgtccgcaccatcgagacgtcgaggggcgctgtcaccgttacggacgatcacccaatgtacatcaggcaggacggcgaagtgactgtccggcctgcttccgacattgaggctgggaccgatctcgtggctgctaggaggccaccagacacgatggtcgagccatcagatgagacggttctgtcctgggagacattcgctgccgattgcgacaagcattctaagctctacggcgtcgactgcgggacagagctggctgctcagagggctgcgcgcgatgagtcccagactgctttcgctgagcgctacggctcgtacgggtctgctgtgggcaagtacgagaggggggagaaggacgttccggtgtggctcctgggcgagctcgacatcaggccagatcggattcacgggctgaactacgagacgtcgttcgagaatccattccctctggagtggtccccagagctggctcaggtcatcggctgcctcctgggcgacgggagcattcaccggaacgacgatgagaatgttgtggacgtgcgctaccataacacagatgaggctctcatcgagcgcttcgccagggacatcgagcgcctgttcgatattgagccaacagtcactgacaggcctggcagggagagccaccataagaggaagtaccaggtcgatgttccatcggctgtcggcagggtgctcgtctgcgttctggaggccgtgacggagaacggcacaccagggctcccagacgcggtccggcctgctttcgttggcgccctgttcgacgatgagggccacatctcccgcgaggggaaggcgttcattagcaatacagaccatactctcctgaccggcgtcggggagatgctcgctgagatgggcatcgagaccaagctcgcgccagaccagcacaagctgcatattaggggcaggaggaacctggagcagttcctggaccggatccctattgcgagcgatgagaagttctaccgcggcctcgatgctctggacgcctacgatgtgaccacgaggaaggctgagctcctggaggcgatcaggcaggagccaaagacctcggctgctctcgctcagactctgggcgtgaccagggggtccgtcaataagtacctcagggagctgcgggagtccggccacatcgagaagcagattgaggggtcaaaccggtccctcgacgagaatcgcacggttcagtatgtggcggctgatttcgagggctccgtgtacgctacgctgaggggggagccgtccagcgtgacagtcgaggacgttgagaggcgggagtacgacggccccgtgtacgatctgacggtttcagagaatgctccaaacttcgctgtcaatgggggggctgtggttcataactctacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2871 - DNA, 1560 bp, Artificial Sequence
  Synthetic Construct, AT-28 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgcggggggacactacggtcgctctcgctgacgggtcggagcgggagattcgggatctcgtggaggctaatctggatgaccctcggccagttgacgatggggtgtgggacggcgtggatgtcgctgttccttccctcgctgctgacggcaggctggttcagcgcagggcgacaaaagtgtggaagcgggaggctccggagacaatgtaccgggtccgcactgctgctggccacaggctcaccgtcacgccatcgcatcctctgttcgtggctgggtctcacggcccagacgccgtcaggacggaggacctggaggttgggcagctggtgggcgtcgccccggacggcgatgggtcgggccaggtcgctccagacggcggggttatcagggatgctcagccagctccagtgggcgacgctgagaccgtcgcctggtccgcgatcgagagcattacggaggtcgagccggatgaggagtgggtgtacgatctggaggtggagggcactcattcatacctcacggatggggtcgtttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2872 - DNA, 2325 bp, Artificial Sequence
  Synthetic Construct, AT-29 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcagttacgggggacaggccagtggtcgttagggatccggggggcacagttcgcattctcccaattgaggatctcttcgctagggggaccacggagtcagaggtcctcatcgctgctgacggcgatgtggtcgcttccgctacaccaggcaagactaggagggctctcgacgggtgggatgctctgtccgtgaacgaggacggcgaggctgagtggcagccaatcgcgcaggctattcggcacaacaccgacaagcctgttgtgaatctccagcataagttcggcgagtcaacaactacccgcgaccactcctacgtcgttccaggcgaggatgggctgacgacagtttccccagacgatgtggctgagccttaccgcgtcagcggcgttccagacgtggagcccgtcgagcaggtggatgtctacgaggttctcaggggctacgagagggagtacgaggacggcaggtcggtggggtctgataactcaatcacaaagaggaagcagattcacgcggacgatgagtatgtgtggttcggccatgagcaccatagggacgttgattcgaccgttaaggtgaagcggttcgtggacatcgattctgaggacggcgctgctctgattaggctcctgggggcctacgtcccagagggctccgccagcaccggggagactgcgaccagcaagttcggcgcttcgctcgctgagtctgacagggagtggctcgctcagctgcagagggattacagccggctgttcgagaatactaccgctggcatcattacatcggacaggagggctgagaggactgtggagtaccagacggacacaggcggggcttcggtcacctacaacgatgagacgctcaagctgcagatgatgaatgagctcgcggctgtgttcttcagggagttcgctggccagacgagcagggggaagcggatcccgtcgttcgtcttccacctgcccgaggagaagcaggacctcttcctgaccctcctggtggagggcgatgggagccgcgagttcccaaggtacacggaggcctacgcgcagcggaacttcgacttcgagacgacatctcgcgagctcgctgctggcctgtcaatgctcctgacgcagagggggcagaagcattctctcaagtaccgggactccaaggatagctacactatccgcacctgctccacgtacagggagggcagggacccagtcctgaccgaggctgaccacgatggctacgtgtacgacctctcagtggaggagaatgagaacttcgtggatggggttgggggcatcgtgctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2873 - DNA, 1659 bp, Artificial Sequence
  Synthetic Construct, AT-30 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcgggggatacggagatcgctctcgcttcgggggattctattactttcgagtcgctggtggacgcttacgagcggggggagacacactactgctacactatcggcgacgatgggcggatccgcattgaggagattatgaacccgcgggtgacccaggaggacgctgctctcctggccgttacgctcgataatggcgaggtcatcaggtgcacacccgaccatgagttcatgctccgggatggcaactactgcgaggcgcagaatctgaccgacgggcagagcctcatgccactgtacaggaccacgacagagatgactgagactaccgagacgacagagactaccgggacagctgagatggtgaagcagccgttcgcccagaacaattgggagtccgtcagccagctcgctaaccgctacaatcgcaggcacacgacaactgaccatatcgttgagacgcagcagattcagtcacagcagcagtcccagatcgagaccgtccagatttctgagagggcggacgttcacaaccataccgtgatctcggtcgagtctctgaccgagacggctgatgtctacgatctggaggttccagttactcataatttcgctctcgcttccggggttttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2874 - DNA, 1641 bp, Artificial Sequence
  Synthetic Construct, AT-31 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2875 - DNA, 2730 bp, Artificial Sequence
  Synthetic Construct, AT-32 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcataccatcctaggtcggaggtcctgctcgctgacgggcagcggattgacatcggcactttcgtggattcgcgcattgagaagaataacgccaatgttatcgacggcattaactgcgagatcctgccggtggacgatattgatgtttacaccgtggacacagatactgggtccgctagcacggtttccattgacagggtgagccggcacccagctccatccgagttcatccgcgtgaagttcagcaacggcaggtcggttctcgtgaccccggagcatcccatgttcatcgacgatgggtcagagaccaagacggtccaggctaatgctctgagcggcggggagttcgttccagctcctcaccatctcccaggcgtgaacaccgacgcgtccagcgtctccgacgatatcaatgatgttagcaccattaggacgcacgtgaggtcccgggcgcgcgctaaggctgaggtcgaggttcgcgctacggacggcgagttcaagctcatcgatgccgcgcagaccctgggcatcattacggctgtggggaaggtgagcgtcgacgctccagagcggggcatcattgtcgacatggatcgcacagttgactcgtctaaggattcgatcaacaatgtcctggggtctgttattccttcaaacgacaatgattctatcactagggtccaggacacaggctcgactgggaaccagtggaggtggtctgtgaataccttcatcgagcggatgatcgagattgctccagctgtcacggctgacaggccaaacaggagggtgcctgatgctgtcctcggcgggagcgaggctgtggtccagcagttcctgacaggcgtgatcattgctgccgggcggatcctcgacgagactatccgcatctacgcttcatccaacgagctcgcctgcgactacgccgatgcgttcctcaggctgggcatcaccgcttccgtcgaggacgggccagctgagatcgcggctcagaccgtgatcaagtgcgacagcgattacgagcgcgcgtgcggcatgttcgacatcagctcgtctaggaccacgccctccgatacatcatcccagaacaatcagagctcggtcaccgcccagaacgaggacacgcaccagacaactagccatgagatcctcccgtcgggcattgcggatgagctgcagagcatcaggcagctcctgaacattcccgcctcggagcagctggcgtctatcacggctggcgacgatgggatcgcgctctcgattgctagggccgagatcaacctcctgcgggaccacattgagacactgcgcatggatactgagaatgtcagcattggccgcgacgattgcgttacaccgactatctcttcatccagcaagtacaagtacgcgaagaactcaatcacctccgacgagaatctccagctgttcggccagtcacaggcccagctgtccgagaggacaaagaccacggagtcgtcttcaatctcggcgtctactgacctcgtgtctatcccagctaacatttcagagaataggctcgtggctgctacacagaggctggacgaggtcgagactcgctgcaaccggcgctaccacagggtcatcgccgttgacacggtgtccaatgccggccctcatgcgtgcgagtgggtctacgatattactgtggagcctaccaacactttcatttcttccggggtcgttctgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2876 - DNA, 2088 bp, Artificial Sequence
  Synthetic Construct, AT-33 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcactcctgatacaaatgttctgacgcctaatggggttcgcaatattcgggatctcacggtcggggattcggtttactcgctgaacccggagaccatgcagatggagatcaagccggtgacacagactcacgagtaccccgactaccagggcgacctcatcgatattcagacaaacgagatcgatttccgcgtcactccaaatcataggatgctggttgaggctaccggcacggacaccacgtccaccaacgactacgatttcatcgaggccgggaatctcgatatttccagccggtacgagctgcctcacggctggtccgttgaccatacggatagcctcggggcctacatcgacctgattaccctcctgagggagcagtcagacacgtacaacgtcctctccgatggcgggatgacaactgctgctacggctgacatcaatcacaacaatgtcacccgcagggttgactctgatacgttcgtgtcactgattggctggtatgtggctacagggcgggtctcgcgcactcagaacggctctgacagggtctacctccagctgtcccagacaaatactaaggcgcggacccagctcacgatgctcctggacgagctgggcgtggactggcaggctgataacgagaagatccacttcgtgtctcatgtctggacggagctcttcgacaccacgtgcggccgcacagagaagaacaagcacatcccggagctgattttcgacgcttcagcctcccagaagagggcgttcttcgatgctatcattaacggcagcggggtcaagaatgacgattcgtaccagtaccacacctcgtctgaggacctcagggacgatatcctccggctgtgcgttcatatcggcattgtggcgcggtacgactacatcaacgatgagtcctggcgcattgagtgcaccgagacggccaatcccgacttcacactgactcatagcggcaggcagtcgacagctgaggatggggtttactgcgtgactgtggcggataatcagactctgctcgccgggaggaatggcaccttccagtggacaggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2877 - DNA, 2601 bp, Artificial Sequence
  Synthetic Construct, AT-34 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccatcctgagactaagatttggttcagggacacagacaatgagtggcatcatgagactattcagactttcgtggaggaccgcctggacgatccagagatcgatgcggttggcacgctcgtgcaggaggtcgacgataacacagaccgggagatctctgtgccttcaattgacgataatggcaacgagcgcctgcagtcagttactgctgtgtccaagcacagggccccaaatcatctcgtgcagatcgagaccattagcggcagggagatcacaattactcctgaccacgagatgcatatcttcgagcagggcaacctggtgtcgaagcaggcttctaagatcacgtcaggggagtacgccgtcatcccgaagcgcctccagacgatttccccatccagccacacacctcagcatgatctcctgagggagttcctcacgcgggatgagctgacagccgacaggctcatcattcacacgtctgacccagtccggctctgcaaccgcgttttccctgaggaggtgacatcatgcaaggatgcggttgagatcatgcagaatactgcttgccatctggacaagaacaaggagaccctcatcggctggctgggcgaggggcgcattccggtcgctctcctgagggggttcgttgagacggacgaggcgctcctgatgagcatccccgacgatgttcagattggcctgaggggggagaaggtgcgcatcgacaggcacattggcttcacggaggagctcacatcgctcctgggctactacgctgctgctgggatcgtgcatacccagacgaatcccatttcctacgagagcgcgcagcaggagcagtcgaggatcaccttctacaacattgatacacagactcagaccgacctcctgaatgccctgaactctgtcttcgagatcgagccgattcagtacaacctggacggcgagatcctcggcgtgccaggggagctcattaggagggtcttcgatactgtcttcgacgttgggacccagccatcccacaagcggatcccccaggctctgttcgatgcctcagagtcccacatcacgagctacctgcgctgcttcttctccactcatgacagcctcaccacggataccagggacatcagcgctacaactgtgtcgcgggagttcaaggaggacatcattgctgctctcaggaggctgggcatcacagctgaggtcaccacgcagcagagcaggtcggtgccagaggtcctcccagactggtacgcgatcgacgatattacgcaccatgacgctgataattccctcaacctgacacggtcctacgtgatctctattgcgtcgtctgatgctgttaccctgcagagggacaggcaggctcaggagcagatcaagtacgacgcgcagggcctcatcgccaacaataacgcgattcaccagagcaggcaagtgactgatggcgggaggaaggactacatcactgagccgatcaccgacattgagtatgtggacgcggatatcgactacacctactgcctcactgtttcggagactcactcactcatcgttaatgatctctctcagaagcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2878 - DNA, 2646 bp, Artificial Sequence
  Synthetic Construct, AT-35 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtcgctgcggactcgcggctggtcgctgtttcgccggatgacaagatcgttttcactactattgaggatttctggaagaagctgaacacgccaatcgagcgcaatgggaagttccggaagcgcacatgcgtctctgagggctggcagacttacgctttcgacgagaaccacgaggcctcactgaggcctatcgagaaggcgattcggtacaccgctgatgagtctgagcagctcaggaggatcaccacgcagctcggcaggtcgctggacattacggatgagcactctctgttccgctacgacgatggcatcgaggaggtggctggggacgatctgaccgctggcgacatcattgtcgcgccgaggaccctcgatgttgaggtgacgcagacaactctcgacctgtccgagtacatccacgataacgagaggtgcccaagcgagcagaccggctcgggggagctcaatctggcctccaagagcgcgatctcggactctaggaacaaggagaccccgggcgtgacgcataatatcctcccccagcggagcaagttcaccgacgagatgaccacgctctcaccaacggctgttggcgggctggagtccgagcagaacgagaccctcagggtcggcgagagcacgggggccatcgagaggtacattaatgtggacgattcgttcggctggctcctggggcagttcatcgcgcagaggtcaatttccacagacgctctgaccatgacggtccacactgccgcggagaagcatgccgagcggatcgttgcgaccagcgactcggtgttcgggattaagccaacggtgaactccatcgagcgcggctacgagattgtgttcccttccgtcttcgacacaatcgtcagcggcctcactgcgaaggagcagagcgagcccgagcaggacgtggatcacacacatactgacgagatcggcattccggagtgcatcctgcacgcccccgacgatattgtcctctccttcctgcaggggttcatcctcgcggagaacgctcagcggaagggcaatgctgcctccgaggccagcgagatggtctctgagtcagagacaactgttaccctggagacgccatcggtcggcgttaaggacgggctcgtgttcctgtgccacaggctcggggtcatcacggatatttcggagaagtctggcgaggagtacagcgttcatttcgaggagtctcgctacacagtgtcaatcgccacagagggcaagactaaccccctcgaccagatcctgaatggggagaggccaacaatgcctgagggcgtgagcgtcccagttccagatgctctcctgactatccacgagtcaattgccaactccccacatatcgaccaggtcattcctgataccgtggtccagcaggagacagtttccctggagactctgcagagcctcctgaccggcctgtcgacggtggacctcccagctcagctggaggctaagcgcgacgagctcacactcctgactgagggcgatctctcttacctgagggtggagtcagtcgagtgcgttgactacgatggctacctgtacgatctccaggttgggggggagccagttttcacagctaattggctctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2879 - DNA, 2238 bp, Artificial Sequence
  Synthetic Construct, AT-36 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcactgcggactcaacagtcatgctcaaggagaaggggatggtctcggtctcggaggtggagacaggggatcagatcgctcagcgctccgacacaggcttccagtacaagccggtggaggagactcacgcgtacgagaacgctgagacactcactgtcaccctgacgaacggctgctctatccgcgggaccccgaatcacaggctcatggtcgacgatgagtggacgcgcatcgacgagattcagcccgatcaggaggttcattacacactcggctggctgagggagactaaccagtccccgcccaagctccactctcagtcacataccacggtgaatcagacagctgactccatcagcccggattccagcgagcccattgagctgtcggagtctgagaacgcggacacgggcaacaggcacaattctgctgttgccgtgaagcagtcacggacacagactcagctgatcagcgacgaggtggtctcgcggccagagcacaccaggaggcctgatcagctctccgaggagctggctgagctcctgggcctctggatcgacacggggctgtggcatcagagcggcgtccagttcaacgttgagcgcgagaatatcgcggagtacattgaccagctctcacagcagctgttcgataccccagctgctatctccgacacggatggcacctacacggtggacattacagatcataagctcaaggagtggtggaaggctaacttcggcgggaagccagacggcactcagtcgtcttacgtcccacagatgatcaaggaggcccctacaaatgttattgaggcgttcctgagggggtgcttcactgctgagggcgggctcaggaaggacatgaggccacggctgtgcacctcatccgaggatagcatcgacgatattgcggtcctcatgatgggcctggggtaccctgtggagaagtcggtcatcaggaacgctgacggcgagccgtactactcggttatgcccgctaccgacgatgggctctctgccttcctgcacgacgtgggcttcatcgatgagcggcgcgagatcgggctctccaacattgagagctcggatagccgggccctgaacaatacccataagatcgaggttgagtcaattgtggagtccccacctgcgacggtctacgacattacagtggcggataatcatgagtacgttacagatggcatcatttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2880 - DNA, 2328 bp, Artificial Sequence
  Synthetic Construct, AT-37 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggaggagaatagcctggtttctaccgatgaggggctgcggcctatcaaggatctggacaatactactgcggagttcgagcagtgggacgagatcgatgtcggcgttaccacggacggcgggaccaagacggctacagctgtttacgataacggcttcgccaatgtgcgccagatccagaccgagagcgggttcaacattgctgctaccccaaatcaccggttccgcacgctgtccagcgacggcacttacacctggaaggaggctggcaagttcgagtccggggaccgcgtgatcctgcagaggaacaccttcgatgctggctcccgcgtgtccctggaggctaatgagagggctgacgatgcccaggacacaactgagggcccagagctgccagggaggatgacgtccgagctggccgagttcctcggctacttcatgggcagcgggtacatctcggacgagacccatgcttccgtggatctggtggtcgacagcgatgccacggagctcaactcatacctgtccaatctcggcgagcagctcttcaggattaccccggccgtcgagtctcaggagatgtcacaggttctgtccttccgggactgccacctcagccgctacttcgaggataacggctggaagaagacggacacaggccataatggggatgcttcggctgctttcgtcccagagcagatcctggagggcgacgagcaggttgtgaacggcttcctcaggggggtgttcgaggcgattgggacggtctcggagaagatcgagattctgaccacgtctacaactctggctgaccagctccagagcctcctgctctcgctgggccacgtgttcacccgggatagcacgaagctcgtcgagacaaacaattaccatgacgatcagctgaggcagaggctctgcggcgctactaggagggaggacgagcggttcatgaacgagatcgggtcactcattgagccagatgagctgaacctctccacacgcgcggacaagaatgatacttacccttcgtctgttatcgaccacgtgcagacactggacggctacgattcagtgtccgagagcctcaagtctcgcattaaccagtcacaggtcgacgggacggttagcaggaagctgatcaaggatattgaggcggagactgctgagaccgtctcgatcgccgaccatgagctcacaggcttctacgcggctactgtggagtctgtcacggaggacacagcgtacactaaggatatttcagttccaagcaacaacacatacatcgccgacgggttcgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2881 - DNA, 1656 bp, Artificial Sequence
  Synthetic Construct, AT-38 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctattgaggctgatgagtcaatcgttattaggcgggacggggagactgagctgacggagatcgggtcgttcgtggacactattctggccgcggacaaccaggagacccggatcacggatggccacgagattgcgctcgctccgaatgggctggaggttccctccctcgacaccgatgagcagatcaggtggaagcacattgaggcggtgagccggcatgcttcgccagacgagatcctcctgattgagctggagtcaggcaggtccatcagggctaccaaggctcactccttcgtcacgaggagggacggcgatgttctcccagtggctggcgagacactggtggtcggggacgtcctccctactgttggcagctacgatcatgcgtcggggtctatctcagtgccgctgcagtcccagagcgtcgctgctgacggcgggaccgttgagcccaacacaaatatcactgccaacgcggagcgcgattcggcctctattacctctgcgggcatcattgggtcggctacgtgggagaggatctccagcattgagacagtggcgccggagtacgagtatgtgtacgatctctctgtttccgggctggagactttcactacgggggagggggtcgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2882 - DNA, 2298 bp, Artificial Sequence
  Synthetic Construct, AT-39 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcactgcggggacaagggttctgcgggctgatacgggggcggagactactatgggggagctgttcgcgctgcaggctagggacgttccggtgtggtcactcgacgagtccctgcgctacgtccgcaggcacctcactagggttttcccaaccggggtgaagccagtcttccggctgaggactgctagcggcaagactgtccgcgctaccgctaaccatccattcctcacctacgatgggtggaagcctctcggcgagctgtcggtggctgacaggctggcggttccgaggcacgtgccagctccagagagggtggcttcatggacggacgatcaggtcctcctgctcggccatctcatcggcgatgggtccttcgtcaagaggcagccactccgctacgctagcgttgacgaggctaacctgtcggctgtgacggaggctgctgctaatgccttctccattgtcgcggttcgggacgagtacgctgctgctaggtgcaccacgctcaggctgccagctccttacaggctgacccacggcaggaggaatccactcgctgcttggctggacgagctcggcctgttcgggctcaggagctacgagaagttcgtcccgcaggaggttttccacctgcccaagaggcagatcgctctcttcctgcggcatctctgggcgactgatggctctgtgacgctgacaaggcagtcacgcggcgggaggatctactacgcctcgacatctctccagctgattcaggacgtctccaggctgctcctgcggttcggcattagcacgagggtgcggacaactaccccaaagggggaccacaggcctggctacacactcgatgtttctggcgtggacgatcagaggcggttcctgcaggagatcggcgtccatggggccaggggcgctaccgctgacaggctcctggaggtcatcagggatgtctccgcgaacacgaatgtcgacacagttcccaggcaggtttgggacgatgtgcgcaggctcctggtggagaaggagatgacgcacagggagttcgctgctgctatggggacatcgttcggcgggtccagcctctggaagcatgctccatctcgcgagaggctcggcagggtggcccaggtcctggactcggccgagctcgatgttctggcggtgaacgacgtcctgtgggatgaggtggtcgcgatcgagcctgacggcgaggagcaggtctacgatgctactgttctcggggggcacaacttcgtggcggatggcattgctgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2883 - DNA, 2154 bp, Artificial Sequence
  Synthetic Construct, AT-40 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacggctgacacatgggttatgacggcctcgggggctaggcaggttcgggatctcattgacaggccattcgaggcggtcgtggacggcgagtgccacccaacagagtcccgcggcttcttcttcactggggataagcctgtgctcaggctgtcgacggctgagggccacacactcaggctgactgcgaaccatccggttctcagggtgtccaagatgaccaggcagctgcgggagacggagtgggttaaggctggcgagctcaggccacacgacaagatcgtcctccacgatcatagggctctgccatcctgggacggcgctcataccgaggctgagggctacctgatcgggctcctgattggcgggggcaccctcacgagggacaaggctatcctgtctatttgggatgctgctgctccaaaggtggctaacgggggcggctcagtcccagctgctggcgtcgccggggttatgagggctgctgagctcgctgctcggaccctgccacaccgcacggacttcaatggctggcagaccacgatggagggcaggggggagtaccacatggctacaggcgccctccatactctcgctctggagctcggcctgacaccaggggataagcgcctcactgcgcctctggagacaacttccagcgctttccacaggggcctcctgagggggatgttcgacgccgatggctcggttcaggggtctcagaggaagggcgtgtccatcaggctcccacagaccgacctcgggaacctgcagacggtccagaggatgctcctgaggctgggcgttgctagcaccattcatcagaataggaggccaggcgggaccaaggtcctcccagatggcgagggcggggctaaggggcactcatgccaggccgcgcatgagctgatcatttccggcgagaatgtggtcaggtacgctgagcggatcggcttcgccgactcggataagatggacaggctcaccgctctcctgcagaggtacaggcacacgaggcatgctgagaggttcatcgcgacagtgcagagcctggaggacgatggcatggaggccgtctacgatgttacagtggcggacgttcatgctttcgatgctaatgggctctacgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2884 - DNA, 1509 bp, Artificial Sequence
  Synthetic Construct, AT-41 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgcgggggacactgagattactgtttcggacgggcggcgctggatgtcgctccctattaggcagttcgttactgagaatttcgacatctcaaagccgggcctcgatcacgttgggacattctactccgacccaaggcagccattctacgtccgctcgattgattctcagggcaagacaagcctcaagcgggtgacttccgtcagcgttcacagggctccagctcatctggtccggttcgctaccaggagggggagggtcctcaccgttacgcctgaccatgcgatgctggtgtgggacacggattacctccgcaagatcaaggctctggaggtggctgtcggcgacagggttccagtggaggagggcgggctcgtggtcgctgatgaggttgtgtctagggagacggtgcaggctctggacgatcgggtctactgcctcactgtggcggagaatcatactctcgttgctaatggcatcttctgcgggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2885 - DNA, 1824 bp, Artificial Sequence
  Synthetic Construct, AT-42 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctgcgggcactctcatcaagacaccaaaggggcctgttcctattgagcagattcagtcgggggatctcgttttcaatgcgatcggcattggggtggtcgagggcatcgtgtgccagcagaagcagaccattacgctggagctgtctgacggcacatcaatcgtctgcactcacgatcatccattcttctgccctcgcggctgggtcgctgctggcgacctggaggttggctccgggctgttcagccacgaggatctccgcaggctgtggtcgggcggggcttctctcggcctggagtccgggtccagcgacggcaggggggctgttcgctcgtctgaggtgctcctgaggatcctcagggaggaggctcgcgagccagatgctggctactgcgggccagccgaggacgtgcgcaacgcgtctaccgatagggctcatgctgagggcgcttggtggcagtggcaggctgacccgattgcgtcagatgaggctgctaggtccgctggcaggagggtcgctgaccgcgttagggacgaggataggagggaggctaggccagagccaaccgctgtcctcctgcaggacaggcactgcgagccactggctaacgatcggaataggagcggcagggagcattcatcccggggcacgggggaggctgagggccagcggcagggggacgtgccatgctcggtccgcgttgtgagcatctcgcgcgaggagaggggcgggcctgaggcggtgtacaacctcagggtttcagggcatccaagctacttcgctgggggggttctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2886 - DNA, 1509 bp, Artificial Sequence
  Synthetic Construct, AT-43 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccatggggacacactcattgagatctacgctgacggcattctggaggagattccgatcaggcggttcgttctggagcatctggatctctcgcaggctggcgtggacgctctggggacgttctacgctgatccggtccggccagctcacgtgcgctccgtcgacacaggcgggatcccacacctccgcaagattacttccgttagcgtgcataaggcccctgcgaacctgatccagttctcgacctctaggggcaagaatctcctggtgacgccggatcatgctatgctcgtttgggacgtgtcctacctccgcaagatcagggccctggaggtcaagattggcgacgctgtcccagtttgggagtcaggggtggtcatctccgacaggatcgtcagcattgattacgttccctgcgaggacgagcgggtgtactgcctcactgtggatagggatcataatgttgtgggcaatggcatcttcactgggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2887 - DNA, 2511 bp, Artificial Sequence
  Synthetic Construct, AT-44 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcaccctgacacatacgttattctccctgacgggcgcatgaagaagatttcggagattgatgaggatgaggttctctcagtcaacttcgaggacctgaagctctacaataagaagatcaagaagttcaagcacaaggctccgaagatcctctacaagattaagaccgcgttctccgagctcatcaccacgggcgagcataagctgttcgtggtcgagaacgggaagatcgtcgagaagtgcgttaaggacctcaatggcagcgagctgatcggggttgtgaggaagctgaactactcgttcaacgacaatgtcgagttcaaggatgtctacgttgagcgccactacaagctcgacgagacaatcaggaacaagctgcgcaaggtgagggagaagctgggcctcactcggaaggatgtggagaagctctgcggggtcaaggagatctacattgttaagatcgagacaggcaagctggagtcaattgaggaggagcggctgaagaagctctgctccctgtacgggatcaacttcgaggagatcatctaccgcgacaacctccactacactaatccagtcaagttccctaagacaccgactcccgagctgatgcagatcattggctacatcattggcgacgggcatttcccctcgaatcggatgctgcgcctcaaggatgagcgcaaggaggtcctggaggagtacaaccagctgttcaagacggtgttcaacctggagggcaatatcaagaagggcgacgggaactactacatcctggagatcaacagcaagtacctgatcgattggttcagggagaacattccggagctcttcaacaagacaggcaatgagaggactcccgagttcgtgttccggctcaacaatgacctggtcgcttcttacctgcggggcatcttcgatgccgaggggtacattcgcgccgaggcgaagcagatcggcattgggatgacatcaaagtgcttcatcaaggagattcagttcctcctgctcaggttcggcatcctcgcctcctacagcaagattaagcggaaggaggagaactggaacaatacccataagctgctcatctcggacaagaagtctttcgagctgttcaagaagtacatcggcttcacggcgaaggataagatggagaagctggaggctatcctgaacaagatgaagggcctcaatttccgctacatctccattccactgaccaagaaggagatcagggagttcgtgggcgtccctctgaagacgattaagaacggggacaattactgcaccgattacacgatcgagaagatcattgaggagctcaactccaagggcctgtacgacaaggccgagtacctcaagcgcttcctggacgcggatatcgtttggacgaagttcaagattgaggaggtggagagcgatgttgagtatgtgtacgatctggaggtggaggactaccacaacttcattggcaatctcatcatcaaccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2888 - DNA, 2517 bp, Artificial Sequence
  Synthetic Construct, AT-45 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcaacgctaacactgagattctgcaggagtcggggttccgcaagattacggagctgaataaggatgagaaggttttcgcgctgtgcggcaaggagatcaagccagtcgacgggtggaaggttcacaagacgcctcagcatgagtacaacatcgtggtcaagacagtcaatggcctggagattaccacgacaccaaaccacatcttcctcgttaaggagaatggctcgctgaaggagaaggaggccaaggacctgaaggttggggattacgttgcgacggtggaccggattcgcgtgaaggagaaggacatcgatctctctaacggcgacctgtacttcattgggtacttcatcggcgatgggtacacaggcgtgatcgagaagaacacgctcaaggctacaccggatctggccttcaaccccaagtacccgcccaatttcgacgattcggagctccacaagaagtacttcctgaagtgccggatttcaaagggcgtcgctcattacatctactccaagaagctccgcaagattttcaacaagctcaatatgctgaccaaggacaacaagaatatcgatgcgttctgcaacctcccgctggacaagctcgcctacctgatcgcgggcctcttcgactccgatgggtacatctacctgaaccggaagaatattgagttctactcgatctctgagaagctcgtggagcagctgcagttcgtcctcctgcggttcggcattcactccagcatccgcaagaagaagaccaagaccatggtgtccccaactaacgggaaggagtacaagtgcaaggacatctacgtcctcaccatccgcgatttcatgagcattaagaggttctacgagaacatccctctccgccatgaggagaagcgcaggaagctggaggagatcattaagaataaggagatcggccagattccgtctgagttcgttgcgctgaggttcacccccatcgctaagatttggtgcgactgcggcttctcagtggatctcactatgttcaagccgcgcaccaagaggcagcgggagctgaacaagaagagggtgaagctcctgttcgagctcctggacggcaagaagctcatcacgaactacaaggagtactacagcaagaggaagaatccctacttcgatttcattgtccgggagaagatcaacggcaacaattactacagcctcaatgagaaggggagggttctgatgtcgctcctgaacaagcacatcaaggacaaggagaatctggaggagatgtacaacttcctcgtgaatctggagaagtgcccaatttgcggcaagcctatccataaggagatgaggtactcctggaagaaggagtgctacgacggggatatctactgggaccggatcaaggagattaagaagatcaaggtcaacgacaagtacgcctacgatatcgagctgccagatgacgggtctaattcacactacatcgttgctaacggcttcatcgtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2889 - DNA, 2190 bp, Artificial Sequence
  Synthetic Construct, AT-46 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttccgcctgacactctgctcatcctggagaatgggttcaagcgcatcgtggacattaaggtcggggacaaggtcctgacgcacgagaaccggttcaagaaggttgagaaggtgtacaagcgcaggtacatcggcgacatcattaagattaaggtgcgctacttcccagaggagatcattctcaccccagagcaccctgtctacgctatcaagacggagaagaggtgcgatggctctcatgggatctgcaagttcaactgcctcacacagtacactaatccttcatgcaagaagcggtaccgcaagtacaagagggagtggatcattgccaaggacctgaaggtcggcgatgtgatcgtctacccgattcccaacagggttcgggacatcaagtacctctccctggataagtacctcagcaatatcaagagggagttctgccgctcccgcatcccggagaagattgaggtctctgaggagttctgccgcctcgttggctacttcctgtccgaggggtactgcttcagggacggcatcgggttcgctctgggcgagaacgagaagaagatcattgacgatatcgagtacctcatgaagaagattttcaatctgaagcccaagatccgcgacgatggccgctcagaggggatcgagctcaagtactactcccgggtgctgcgcgacttcttcggcgatatgttctactgcggggacgagaagcgggcctggaacaaggcgctcccaaatgagttcctctacctgcctaagaacaagcagctgcagatcttcattggctggtggaggggcgataagggggtcaccacgtcggagattctgatgaaccagctcaggctgatcagcctccggctgggcttcatcattaccttctcgaagcacgttccgaagaatcccaagatcggcgacagggaggtcatcaagtaccatgctaggtggcagggccgcgtgtccatcctcgacgagaagattgtcgatgagctcaagaacgaggacatcaagctgccgaagaaggatgttcgctacggctggatcaaggggaattacctgtacgctcccatcattaggatcggccgggagtactacgacgggttcgtctacaatctggaggtggaggatgactcttcatacgttacagtctcaggcactctgcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2890 - DNA, 2652 bp, Artificial Sequence
  Synthetic Construct, AT-47 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgatgccgcatgagaaggtgctgacggagtacggggagattaagattgaggacctgttcaagatcgggaaggagatcgtggagaaggacgagctcaaggagatcaggaagctgaatattaaggtgcacactctcaacgagaatggcgagatcaagatcattaacgccccatacgtgtggaagctcaagcataaggggaagatgatcaaggtcaagctgaagaactggcactcgatcaccacgacaccggagcatcccttcctgaccaacaatggctggatcaaggcggagaatattaagaaggggatgtatgtggctatccctcgcaagatctacggcaacgaggacttcgagaagttcatcgagttcattaattccaagatcctcacgaacgagctgattgtgaaggtcaatgagaaggacctcaagaacgttgagctgccgtcaacaaagatctacaagaagcagaagaacgtgttccgctccgaggatatcattgagcacaacctcaatatcgagaagatttcgttctctccacggatccaccgctgcggcaagccacagcattacatcaagctccctaagtctctgaacgagtggaaggccatcttctacttcgctggcgtgatgttcggcgacgggtgcgtcgatcggatcgcgaacaatgacgaggaggtcttcaacaagctgaagtcactcaacaatctgggcatcgaggttgagaggattaagcggaagtccagctacgagatcattttcaagaacgggaagaatgctctcatcaacctcctgaagattctgttcgattacccgtctgagaagaagtcacataacatcaagattccgcagatcctctacattgctcccaaggagctggtggccgagttcatcaagggctacttcgacgccgatggctacgtgaatctccgccagaacaggatcgaggttatttcagcgtccaaggagttcatcgagggcctgtccattctcctgctccgcttcgagatcacttccaagatctacgagattaagaagagctacaaggagaccaagaagaagtactaccagctcaacatcgtcggcaagaggaacctgaagaatttcaagaacatcgggttctccattaagtacaaggaggagaacctgaataagatcattgagaagagcaggaagtcggagaagtaccccatcaacaaggacatgaagcgcctcaggattctgttcggcatgacgcggaatgaggttaacgtgagctactacgccaagtacgagaacgggaaggagatcccatcgtacgagattgtgaagaagttcctcaattctctgaagcctaagaacctcgataagaagatcaaggttctggagggcaaggagcgcgacgtgaattacctcaaggctttcgagagcgatggcctgatcgagaacgggaggctcaccaagctgggcagggaggccctcaatatctggaagaaccacgagttcgggaaggagaatatcgactacatgaagtcgctgatcgagaacattgcgttcgtcgaggttgaggatgtcgagatcattgactacgatggctacgtttacgatctcacaacagagactcataacttcattgctaatggcatcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2891 - DNA, 1518 bp, Artificial Sequence
  Synthetic Construct, AT-48 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctctcgcctacgatgagcctatctacctctcggatggcaacattatcaatatcggggagttcgtggataagttcttcaagaagtacaagaacagcatcaagaaggaggacaatggcttcgggtggatcgatattggcaacgagaatatctacattaagtccttcaacaagctcagcctgatcattgaggacaagcggatcctccgcgtctggcgcaagaagtactcggggaagctgatcaagattaccacgaagaaccgcagggagatcacactcactcacgatcatccggtttacatctctaagaccggcgaggtgctggagattaatgccgagatggtgaaggtcggggactacatctacattcccaagaacaataccatcaacctcgatgaggttattaaggtggagacggtcgactacaatggccacatctacgatctgactgtggaggataatcatacttacattgctggcaagaatgagggcttcgctgtttccaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2892 - DNA, 2250 bp, Artificial Sequence
  Synthetic Construct, AT-49 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcattgagggggacgctaagattctgacggatcgggggttcctgaagatgaaggaggtttacaagctcgtgaagaatggggagaagctcaaggtcctcggcctgaatgctgagacactgaagactgagtggaaggagatcattgacgctcagaagagggaggctaggcgctacgagatcggcgtgtaccgcaagaataagaacaccaaggacacgatcaagattacaccggatcacaagttccccgtgttcgtcaacggcgagctcagcaaggtgcagctgtgcgacatcattgataacaatctctcagtcctgtccatcgactacattccaatgatcgaggagaagtacgagtccctcgctgaggtcatgtacctcggcggggctgtcctgagcgatggccatatcgttcggaggaacgggaagccaattcgggtccgcttcacacagaaggacactgaggagaagaaggatttcatcgagaaggttaagggcgacgtgaagctcatcggcgggaatttcatcgagatttcgaaccgcaacaatgtcatcgagtaccagacctctaggaagattccgtcagagatcctgggcttcattgaggttaatattaacacaatccccctctacgccactaaggacgagatcgccgatctgattgcgggcttcgttgacggcgatgggtgcctctccgggaagaggagggtggagatctaccagaactccagccacattaagaagatcgagggcctcatcgtcgggctctacaggctgggcatcattccgaggctgcggtacaagcggtcgtctaccgcgacgatctacttcaacaacaacctggagaccatcctgcagcgcacgcgcaggattaagctcgacaagctgaaggagttcaagaagccagtggaggacaagaagctgatcgatatttcgcagatcctccctgagctgaaggagttcgactacaagggctacctctacaagacctacaaggagaagctgttcatcgggattaacaagctggaggagtacctgtctaagatcgacaaggatggcattgagcgcatcaagcagaagatcaagctcctgaaggagagcgacatctactcgatcaggattaagaaggtcggcgaggattacggggaggtctacaatatcacggttaaggcggagaacgagttcaatcataactacgtggtttggactaagcattacacacctatcgtggttttcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2893 - DNA, 2121 bp, Artificial Sequence
  Synthetic Construct, AT-50 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccatccaaaggggacaaaggtcgtggtcaagggcaagggcatcgtgaatattgaggacgttaaggaggggaattacgttctcggcatcgacggctggcagaaggttaagaaggtctggaagtacgagtacgagggcgagctcattaacgttaatgggctgaagtgcacaccgaaccacaagatccccctccgctacaagattaagcataagaagatcaacaagaacgattacctggtgagggacatctacgcgaagtcgctcctgaccaagttcaagggcgaggggaagctcatcctgtgcaaggacttcgagacgattggcaactacgagaagtacatcaatgacatggatgaggacttcatcctcaagtccgagctgatcggcattctcctggctgaggggcacctcctgaggagggatatcgagtacttcgactccagccggggcaagaagcgcattagccatcagtaccgcgtggagatcacggtcaacgaggatgagaaggacttcatcgagaagattaagtacatcttcaagaagctcttcaactacgagctctacgtgcgccgcaagaagggcaccaaggccattacgctcgggtgcgcgaagaaggatatctacctcaagattgaggagatcctgaagaacaaggagaagtacctcccgaatgccatcctgcgggggttcttcgagggcgacggctacgtgaacacagttaggcgggctgtggtcgttaatcagggcactaacaattacgataagattaagttcatcgccagcctcctggacaggctcggcatcaagtacagcttctacacatactcgtacgaggagagggggaagaagctgaagcgctacgtgatcgagattttctctaagggcgacctcattaagttctcaatcctgatttcgttcatctctcgcaggaagaacaatctcctgaacgagatcattaggcagaagactctgtacaagatcggcgattacgggttctacgacctcgacgatgtgtgcgtctcactggagtcctacaagggcgaggtgtacgatctcactctggagggcaggccttactacttcgccaatggcatcctcactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2894 - DNA, 2442 bp, Artificial Sequence
  Synthetic Construct, AT-51 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccagcattctccctgacgagtacctgactattattgaggaggatggcattaaggtcgtgaagatcggggagtacattgatgatctcatgcgcaagcacaaggacaagatcaagttctcgggcatctctgagattctggagacaaagaacctcaagactttctccttcgataagatcacgaagaagtgcgagattaagaaggtgaaggcgctgatcaggcacccatacttcggcaaggcttacaagatcaagctccggtctggccgcaccattaaggtcacgagggggcattcactgttcaagtacgagaacgggaagatcgtcgaggttaagggcgacgatgtgcggttcggggacctgatcgtggtcccaaagaagctcacctgcgtcgataaggaggttgtgatcaacattcctaagcggctgatcaatgctgacgaggaggagatcaaggatctcgtcattaccaagcacaaggacaaggccttcttcgttaagctcaagaagacgctggaggatatcgagaacaataagctcaaggtcatcttcgacgattgcattctctacctgaaggagctcggcctgatcgactacaacatcattaagaagattaataaggttgacatcaagattctggatgaggagaagttcaaggcctacaagaagtacttcgacaccgtcatcgagcatggcaacttcaagaaggggcgctgcaatattcagtacatcaagattaaggactacatcgcgaacattcccgacaaggagttcgaggattgcgagatcggcgcctactcggggaagattaatgcgctcctgaagctcgacgagaagctggctaagttcctcggcttcttcgtgacacgcgggaggctgaagaagcagaagctcaagggcgagactgtctacgagatctcagtttacaagtccctcccggagtaccagaaggagatcgctgagacattcaaggaggtcttcggcgccgggtccatggttaaggacaaagtgactatggataacaagatcgtgtacctcgtcctgaagtacattttcaagtgcggcgacaaggataagaagcacatccccgaggagctcttcctggcctccgagagcgtgatcaagagcttcctggacggcttcctcaaggccaagaagaacagccataaggggacctcgacgttcatggcgaaggatgagaagtacctcaaccagctgatgatcctcttcaatctggttggcattccgacaaggttcactcccgtgaagaacaagggctacaagctcaccctgaatccgaagtacgggacggtgaaggacctcatgctggatgaggtcaaggagatcgaggcgttcgagtacagcggctacgtctacgatctctctgtggaggataatgagaacttcctcgtcaacaacatctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2895 - DNA, 2658 bp, Artificial Sequence
  Synthetic Construct, AT-52 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacgggggacactaaggtcatcgtgaatggggagattcgggagatcggggaggttattgaggagatttctaacgggaagttcggcgtgacactcactaacaatctcaaggtcctgggcatcgacgaggatgggaagattcgcgagttcgacgtgcagtatgtgtacaaggataagaccaacacgctcatcaagattaagacaaagatgggcagggagctgaaggttaccacgtaccacccgctcctgatcaatcataagaacggcgagattaagtgggagaaggcggagaacctcaaggtcggggacaagctggctacgccccgctacatcctcttcaatgagagcgattacaacgaggagctcgctgagtggctgggctacttcatcggcgacgggcacgccgataaggagtcgaataagatcacattcactaacggggacgagaagctgcggaagcgcttcgccgagctcaccgagaagctgttcaaggatgcgaagatcaaggagcgcattcataaggacaggacgccagatatctacgtcaactccaaggaggcggttgagttcatcgacaagctcggcctgagggggaagaaggctgataaggtgcggatccctaaggagattatgcgctcagacgctctcagggcgttcctgagggcttacttcgactgcgatggcgggatcgagaagcactccattgttctcagcaccgcttcgaaggagatggccgaggacctggtgtacgctctcctgaggttcggcatcattgccaagctgcgggagaaggtcaacaagaacaataacaaggtttactaccatatcgtgatttccaactcctccaacctccgcaccttcctggacaacatcggcttctctcaggagaggaagctcaagaagctcctggagatcattaaggatgagaatccgaacctggacgtgatcacgattgataaggagaagatccggtacattagggaccggctcaaggtcaagctgacacgcgacatcgagaaggataattggtcctacaacaagtgcaggaagatcactcaggagctcctgaaggagatctactaccggctggaggagctgaaggagatcgagaaggccctggaggagaacatcctgattgactgggatgaggtggccgagcgcaggaaggagatcgcggagaagacaggcattcgctccgaccgcatcctggagtacattcgggggaagcgcaagccaagcctcaagaactacatcaagattgccaatactctgggcaagaacatcgagaagatcattgacgcgatgcggatcttcgctaagaagtactcgtcttacgcggagatcggcaagatgctgaatatgtggaactcatccatcaagatctacctggagtctaatacccaggagatcgagaagctggaggagattaggaagacggagctcaagctggtcaaggagatcctcaacgacgagaagctgatcgattctattggctacgtcctcttcctggcgtcaaatgagatctactgggacgagatcgttgagattgagcagctcaacggggagttcaccatctacgatctgcatgttccacgctaccacaacttcattgggggcaacctgcctactattctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2896 - DNA, 2322 bp, Artificial Sequence
  Synthetic Construct, AT-53 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtctctaaggacacacctattctcgtgaagattgatggcaaggttaagcgcactactttcgaggagctggacaagatctacttcgagaccaacgacgagaatgagatgtacaagaaggtggacaacctggaggtgctgacagtcgatgagaatttccgggttcgctggaggaaggtgtcgactatcattaggcacaaggtcgacaagatcctccggattaagttcgagggcgggtacattgagctgacgggcaaccattccatcatgatgctcgatgagaatgggctggtggccaagaaggcgagcgacatcaaggtcggcgattgcttcctctcgttcgtcgcgaacatcgagggcgagaaggaccggctcgatctgaaggagttcgagccaaaggacatcacctcccgcgtcaagatcattaacgacttcgatatcgacgaggatacggcttggatgctcggcctctacgtggctgagggcgctgttgggttcaagggcaagacctcaggccaggttatctacacgctcgggtcccacgagcatgacctcatcaacaagctgaatgacattgtggataagaagggcttcagcaagtacgagaatttcacaggctcggggttcgaccggaagcgcctgtctgcgaagcagatccgcattctcaacactcagctggctaggttcgtggaggagaacttctacgacggcaatgggcgcagggctaggaacaagcggatcccggatatcattttcgagctcaaggagaatctgagggtcgagttcctcaaggggctggctgacggcgattccagcgggaactggcgcgaggtggtcaggatttcgtctaagtctgacaatctcctgatcgatacagtgtggctcgccaggatctcaggcattgagtcatccattttcgagaacgaggcgcggctgatctggaagggcgggatgaagtggaagaagtctaatctcctgccggccgagcccatcattaagatgatcaagaagctggagaacaagattaacggcaattggcggtacatcctccgccaccagctgtacgagggcaagaagcgcgtctccaaggacaagatcaagcagattctggagatggtcaacgttgagaagctgtccgacaaggagaaggaggtttacgatctcctgaagaagctgagcaagaccgagctctacgcgctggttgtgaaggagatcgagatcattgactacaacgatttcgtctacgacgtctctgttccaaacaatgagatgttcttcgctggcaatgttccaattctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2897 - DNA, 2643 bp, Artificial Sequence
  Synthetic Construct, AT-54 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacgggggacgctaagattactctgcctgacgagcgggagatcaagattgaggatttcattaagatgttcgaggagcgcaagctgaagcacgtcctcaacaggaatggggaggacctggtgctcgctggcgtcaagttcaactccaagatcgttaatcacaaggtgtacaggctggtcctggagagcgggagggagatcgaggctaccggcgaccataagttcctgacgagggatggctggaaggaggtgtacgagctcaaggaggacgatgaggttctggtgtacccggctctggagggcgttgggttcgaggtggacgagcgcaggatcattggcctgaacgagttctacgagttcctcacaaattacgagatcaagctggggtacaagccactcggcaaggcgaagtcatacaaggagctgattactcgcgacaaggagaagatcctctctagggtcctggagctctccgataagtactccaagagcgagatccggcgcaagattgaggaggagttcggcatcaagatttctctgaccacgatcaagaacctcattaatgggaagatcgacggcttcgccctgaagtatgtgcgcaagatcaaggagctcggctgggatgagatcacctacgacgatgagaaggctgggatcttcgccaggctcctgggcttcatcattggcgacgggcacctgtcgaagtctaaggagggccggatcctgattacagctactattaacgagctggaggggatcaagaaggatctggagaagctcggcatcaaggcctcgaacatcattgagaaggacattgagcataagctcgatgggagggagatcaagggcaagacctctttcatctacattaacaataaggccttctacctcctgctcaacttctggggggtcgagattggcaataagacgatcaacgggtacaatattccaaagtggatcaagtacggcaacaagttcgttaagagggagttcctgaggggcctcttcggggctgacggcacaaagccttacatcaagaagtacaacatcaatgggattaagctgggcattcgggtggagaacatctccaaggataagactctggagttcttcgaggaggtcaagaagatgctggaggagttcgaggtcgagagctacattaaggtttcgaagatcgacaacaagaatctgaccgagctcatcgtcaaggccaacaataagaactacctgaagtacctctcaaggatctcctacgcgtacgagaaggacaatttcgctaggctggtgggcgagtacctccggatcaaggaggcgtacaaggacatcattctgaaggagatcgccgagaacgcgctcaaggaggccgatggcgagaagagcctgagggagctcgctaggaagtacaacgtcccggttgacttcatcattaatcagctgaaggggaaggatatcggcctcccccgcaacttcatgacgttcgaggagttcctcaaggagaaggtggtcgacggcaagtatgtgtccgagcggatcattaagaaggagtgcatcggctaccgcgatgtgtacgacattacttgccacaaggatccttctttcattgctaacggcttcgtctctcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2898 - DNA, 2496 bp, Artificial Sequence
  Synthetic Construct, AT-55 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacaccggacacatacgtggttctcggggacgggcggattgagactattgaggacatcgtgaatgctaaggagcgcaacgtgctctccctggacctcgataacctcagcatcaagattgacacggcgatcaagttctggaagctgcgctacaacggcaatctgagcaagatcacactctcgaacaattacgagctcaaggctactccggaccactgcctcctggtgctgagggataaccagctcaagtggatccccgccaaggacattaaggagaacgattacatcgcgatgccgttcaattacaaggtcgagcggaagcccatctccctcctgaacctcctgaagtacctggacatcacagatgttctcattgagttcgacgagaactccactatcttcgagaagattgccgagtacatccgcaacaatattaagacctcaacgaagtacaagtacctcaggaaccgcagggtcccgctgaagtacctcatcgagtggaatttcgacctggatgagattgagaaggaggctaagtacatctacaagtccgttgccgggaccaagaagatccccctgttcaagctcgacgagaggttctggtacttcgctggcctggtcctcggcgacgggtcgatccaggattctaagatccggattgcccagaccccactgaaggacgtgaagagcattctcgatgagacgttccctttcctgcacaactggatctcgggcaatcaggtcatcatttctaacccaatcattgccgagatcctggagaagctcggcatgaggaacgggaagctcaatggcatcattttctcactgcctgagtcctacatcaacgccctcattgcggggtacttcgacaccgatggctgcttctcgctcctgtacgacaagaaggcgaagaagcacaacctgcgcatggtcctcacgtcaaagcggcgcgatgttctggagaagatcgggatctacctcaactccatcggcattctgaatacactccataagtctagggaggtgtactcactcatcatttccaacaagagcctggagactttcaaggagaagatcgcgaagtacctgaagattcggaaggaggctttcatcaacggctacaagacatacaagaaggagcatgaggagcgcttcgagtgcgacctcctgccagttaaggaggtgttcaagaagctcaccttcgagaagggccggaaggagatcctgaaggactccaagatccacattgagaactggtacaaggagaagaccaacaatatcccgagggagaagctgaagacggttctccggtacgcgaacaatagcgagcataaggagttcctggagaagatcgtgaacggggacatttcgttcgtgcgcgtcaagaaggtggagaatatcccgtacgatggctacgtctacgatctctctatcaagcataatcagaacttcatctctaatggggtcatttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2899 - DNA, 2373 bp, Artificial Sequence
  Synthetic Construct, AT-56 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctggggcgggatgagctgattttcattaaggagggggacaagctgaaggtttgcaagatcggggaggctattgatgagttcatggagaagtacaaggataagatcattgttgatggggacacggagatcctgtacctcgacggcattgctgaggtgtacaccatctccgtgaacgtcaagacggggaaggccgagttcaagagggtctacgcgatcagccgccacaagccgaggggcaaggtctacaaggttatcggcaaggacgggacctctatcattgttacggaggatcactcactcttcaactacgacgagaacggcaatctggtttgcgtgaagccgcgccagatgaagcatatcattaggaacttcaacaatccctacgatgtggagtaccggatcggcgactacattgagacaaattaccagaggactgattccaagtacaacagccggcagaatgacattcccgagaagctcaagatcacaaaggagctgtgccagttcctgggcctcttcgtcgcggaggggtcatacatcactaacggcatctccattaccacgaaggacgatgacatcgctaagttcattgagcggttcgtgaaggagcagatcaacgagaatattgccgtcaagcgctacgaggattcggtgcggttcgtcaacaaggggttctaccgcttcctcaaggagcacatcaatggcaaggcgattaacaagaatagcccggagttcatcctgaagggcgacaaggagatgaagctggctttcctcggcgggctgatctcgggcgatggctacgtgtccaaggacggccgcgtgcagatctacacaacttccgagcagctcctggggcagctccatctcctgctcagcgacctgggcatgatctactcgattacaaagatcaaggaggagggcgagaagatcgagattaagcggaacgagatcgtccgcaattacaagctctacgttatcgagattgccaagaactgcaccgaggacctgaagccctacgtgatccccaagtacaagaaggagaggatcaagccagcgaactacgatcagctcccttacgactaccggatcattaaggagcacctgcgcaagatcaccgataagaagccatacaacgactacgcctggaagtccaacaatcgcaagctgaagctcaacacgctggagaagatcgagcagctcaatccacatctgagggaggagattaacaagttcaagctgaatatccctttcgagattaaggagatcaaggagattgactacaacggctacgtctacgatctctcagtggaggataatgagaacttcatcacagctacaggcatcctctgccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2900 - DNA, 2613 bp, Artificial Sequence
  Synthetic Construct, AT-57 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctcccttacgatgagaagatcctcattttcgagaataacgagtacaagctggtcaagatcggggagttcgtggagaagtacctcaaccgctacaaggacagggccatcacctacggcgataacaatatcgaggtgtacattaaggacgagaatatctacgccccatcgttcgacaaggatggcaagatcgtcctgaagcctatcacgcacgcgattcggcatcgcgggaaggagatctacgagattgagctggagtcgggcaagaaggttagggtgaccggggaccactctgtgttcacgatcaacgacaatctggatgtggtcgaggtcaaggctagcgacctcaaggttggcgatttcatcattacaccgaagatcattccctcaatctccaaggacaagatctacctctcggagatcgtcaagaacaaggacaagtactacgttaagatcaaggatcacatcaagttcattgaggagcatgaggagatcctcaaggagtcctacaaggagtacaagactaagtggaaggacctgaagccggttctcaagaagaagaacgcgttccggctcgatctgatcgaggacctggtcgataaggagaagatcgagaagatttcttacggccacgctaactacatcaacaataagattaagctcgacgagaagttcggctacctgatcggggccttcctctcagagggccattggaacgacaagtgcgtggagatttccagcaccaacaaggagttcatcgagaatctggtcgagatcattgaggagattctcggcaaggacgcgtactacatcacagtgaagggggacaagcgcaggtacaaggacctctacgtgatcggcctcaacaagactgtcgctatgatcttcgagtccctcgggctgaacaagctgtcgtctaataaggagatcccgagcattctcctgtcgaatgagacgttcctgaagggcctcatcaaggggtacattgacggcgatgggtcaatctacgtcgacgagtctaagcgggattactcaatccgcctgtacaccacgtccgagacactccgcgacactctctgcctggcgctcaagatcctgggcattaactaccggctctccatcgacaagaagagcaaggttaacgagaattggcgcgattgctacgtgatcaagattaccggcaaggagaacattgagaagctcctggacgtcgagatcaagaacaatggcgggaaggatgttatcccgaagattgccgagaagttcaaggagatcattaaccagtactcccagagggagtggaaggagcggttcggcattgacgtgaacaatctgcatatctgggaggatctcaagaagggctacatgagcaggtaccgggcgaagaaggttctcaacattatgaagaatgtgaaggagatcgaggagaagtacggcaggctcctggacaagatcgggcagctgattgacaacgatctcctgttcgagcgcatcaagagcattagggtgctcgacgagatccccgagtatgtgtacgatatttccgtggagggcacagagaacttcattgggggggagggcttcatttgcctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2901 - DNA, 2370 bp, Artificial Sequence
  Synthetic Construct, AT-58 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggatactacagtgctgctggacggcaagctcatcaagatcaaggatctggaggacaagtggaaggacgtgaaggtcctcacatcggacgatctgaacccgaagctcacttccctgagcaagtactggaagctcaatgctgacgagtacgggaagaagatctacaagattaagaccgagctgggccgggagatcattgcgacggaggatcaccccttctacaccacgaacggccgcaagaggtgcggggagctcaaagtgggcgacgaggtcatcatctacccgaacgatttccccatgttcgaggacgataatagggttattgtggacgaggagaagatcaagaaggtcatcaacaacattggcgggacctacaagaacaagatcattaatgagctgaaggacaggaagctcatcccgctgacgtacaacgatcagaaggctagcattctcgcccggatcgttggccacgtgatgggcgacgggtctctcatcatcaacaacaagaactcccgcgtggtcttccgcggcgacattgaggatctcaagaccatcaaggaggacctcaaggagctgggctacgatggggaggagatcaagctgcatgagggggagaccgagatcacggactacaacggcaagaagcgcatcattaagggcaaggggtacagcttcgaggtgaggaagaagtcgctctgcatcctcctgaaggctctgggctgcgtcggcggggacaagacaaagaagatgtacggcattccaaactggatcaagactgcgcctaagtacatcaagaaggagttcctctcggcttacttcggctctgagctgacaactccgaagatccgcaaccacggcacctcattcaaggagctctccttcaagatcgcgaagattgaggagatcttcgacgaggataggttcattaaggacatcaaggagatgctcaaggagttcggcatcgagctgaaggtcagggttgaggaggggaacctccggaaggatggctacaagacaaaggtctacgtggcctccatctacaaccataaggagttcttcggccggatcgggtacacctacgcgaataagaaggagacgctggcccgctacgcgtacgagtacctcctgacgaaggagaagtacctcaaggaccgcaacatcaagaagctggagaacaatacaaagttcattactttcgataagttcatcaaggagaagtgcctgaagaatggcttcgttaaggagaagattgtcagcatcgaggagaccaaggtcgactacgtttacgatattactactatttcagagactcataacttcattgctaatggcttcctcacgggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2902 - DNA, 2427 bp, Artificial Sequence
  Synthetic Construct, AT-59 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgccatacgaggagaagattattattaaggagggggagttcattaagccagtggagatcgggaagctcgtggatgagatgattgagcgcttcggcttcgagaagatcgggaactctgaggtctgcgacctcccgatcgatatctacgccctctcactggaccaggatgagaaggtgcactggaagcggatcatttcgtgcatccgccacaagcataatggcaagctgatcaagattaagaccaagagcgggagggagattaccgcgacgccgtaccactcgttcgtcatccggaaggataacaagatcattcccgttaagggctccgagctcaagatcggggacaggattccggtggtcaagcatatccccgcgaattgcgttgaggctatcaacatttccgactacgtgagcggcaattacgttgtggataacatcaacaataagattgccccaaagatcaacggcaagtccattcctaacaatatcaagctcgactacgatttcggctacttcatcgggatctacctcgcggagggcagcgtcaccaagtacttcgttagcatctcgaatgtggacgagctcattctgaacaagatccgggccttcgcggacaagctcggcctgaactacggggagtacgataacaataacggcttcgcggagtcgcatgacatccgcatctactcctccaccctcgctgagttcctgtctaatttcggcacctcgtctaacacgaagaagatcgccgagttcgtgttcggggcgaacaaggagttcgtccggggcctcatcagggggtacttcgacggcgatgggaatgtcaacgccgacaggaaggtcattcgggttacatctaactcaaaggagctcatcgacggcatcgctattctcctggcccgcttcaatatcttcagcattaagacaaagactaagaaccagttcgtgctgatcattccccaccgctacgcgaagaagttccatgaggagatcaatttctcggtcgagaagaagaagtccgagctggagaggctggtgtcatccctgaacgacgataagacatacgactcaatcgatatgattccatccatcggcgatgctctcactaagctgggggagaaggtcgactaccctaaggttatcctcaagaagttcgagcggaagcagaagatcggcagggctaccctccagaggcacctgcgcaggatcgaggagctggctgtgaagaagggcgtcaacatcctcgccctgaaggagtactggctcctgaagaaggccgttgagtccgacgtgatctgggatgagattgtcaagatcgaggagattagctgcgacaagaagtatgtgtacgatatttctgtggaggggctggagactttcactactttcgatggggttctcactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2903 - DNA, 2478 bp, Artificial Sequence
  Synthetic Construct, AT-60 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacatcaaattcaaagatcctgacagacgatggctactacattaagctggagaagctcaaggagaagctggacctgcatattaagatctacaacaccgaggagggcgagaagtccagcaatattctgttcgtgtcggagcgctacgcggatgagaagatcattcggatcaagaccgagtcggggagggtcctggagggctctaaggaccacccggtgctgacgctcaacggctacgtgcccatgggcatgctcaaggagggggacgatgtgatcgtctacccatacgagggcgtggagtacgaggagccttccgacgagatcattctcgatgaggacgatttcgcggagtacgacaagcagatcattaagtacctgaaggataggggcctcctgccgctccggatggacaacaagaatatcggcatcattgctaggctcctggggttcgccttcggcgatgggagcatcgtgaaggagaacggcgacagggagaggctctacgtggccttctacgggaagagggagaccctcatcaagattcgggaggacctggagaagctcggcatcaaggccagccgcatctactcccgcaagcgcgaggtcgagatcaggaacgcgtacggcgacgagtacacatccctgtgcgaggataattctatcaagattacttcaaaggccttcgcgctgttcatgcataagctcgggatgcccatcggcaagaagacggagcagatctacaagattccagagtggatcaagaaggcccctaagtgggttaagcggaacttcctggctggcctcttcggggctgacggctctcgcgcggtcttcaagaactacaccccgctgcccatcaatctcacgatgtcgaagtctgaggagctcaaggagaacatcctggagttcctcaatgagattaagctcctgctcgctgagttcgatatcgagtcaatgatctacgagattaagtccctggacggccgcgttagctacaggctcgccatcgtgggcgaggagtcaattaagaacttcctggggcgcatcaattacgagtactccggcgagaagaaggtcatcgggctgctcgcgtacgagtacctccgcaggaaggacatcgctaaggagattcgcaagaagtgcatcaagagggcgaaggagctgtacaagaagggcgttacagtgagcgagatgctcaagatggatgagttcaggaacgagttcatctcgaagcggctgattgagcgcgctgtctacgagaatctcgacgaggacgatgttcggatctccactaagttcccgaagttcgaggagttcatcgagaagtacggcgtcattggcgggttcgttatcgataagattaaggagatcgaggagatttcatacgactccaagctgtacgacgtgggcatcgtttcaaaggagcataacttcattgctaacagcatcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2904 - DNA, 2019 bp, Artificial Sequence
  Synthetic Construct, AT-61 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtggactacaatgagcctattattattaaggagaatggggagattaaggtcgtgaagatcggggagctgattgacaagattattgagaactccgagaatatccgcagggagggcatcctggagattgccaagtgcaaggggatcgaggttattgcgttcaactcgaattacaagttcaagttcatgccagtttcggaggtgtctaggcaccctgtgtctgagatgttcgagatcgtggtcgagggcaacaagaaggtcagggttacacggtcccatagcgtcttcactatccgggacaatgaggttgtgccgatccgcgtggacgagctgaaggtcggggatatcctggttctcgcgaaggagctccccaacatcgaggaggacatcgagattgataagaagttctcaaagatcctgggctacatcattgctgaggggtactacgacgataagaagatcgtgctctcttacgactacaacgagaaggagttcatcaatgagaccattgattacttcaagtcactgaactccgacatcacgatctacagcaaggatctcaatatccagattgaggtgaagaacaagaagatcattaatctcctgaagaagctgcgcgtcaagaacaagaggatcccgagcatcattttcaagtcgccctacgagatcaagaagtctttcatcgacggcattttcaacgggaaggatgctaaggtgttcgtctcaaaggagctcgccgaggacgtgatcttcctcctgctccagattaaggagaacgccacaatcaataagaagtcgatcaacgatattgaggtctacgaggttcggcgcatcaccaacatctacacgaatcggaagctggagaagctcatcaactccgacttcattttcctcaagatcaaggagattaataaggtcgagccgacgagcggctacgcgtacgacctcactgttccaaatgcggagaatttcgttgctggcttcgggggcttcgtgctccacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2905 - DNA, 2376 bp, Artificial Sequence
  Synthetic Construct, AT-62 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccatccggatgaggttctcttcattgatcgggggcgggggctggagtgcattactttcaaggagctgttcgagctggaggacaaggacaacgtgaagatcctctccttcgatggcgagaagctcagcctgaagaagctcaagctggcctccaagcgctactacaatgacgatctcatcaccctgcggttcaacctcggccgcgagatcaagattacgaaggaccacccagtggtcattctggaggatggcgagctcaagatcaagctgacatctgacgtgaaggagggggataaggtcatcctgccctacggcaacttcggggaggagagggagatcgagattgacatcctggaggagctgagcaagacagatctcattgagaaagtgtggatccacaacaaggacctggcgactaatgagttcaacatcattaagccatacctctcgaataagtaccctcatgacgtcaagaggaacggcaccatccgggctaaggacattctcccgatcaaggagattctggataagtacgggtccaagaaccggctgttcacggcgaagtcgaagtctaccacgatcccctacaagattaagatcgacaaggatttcgctcggctcattggctactacctgagcgaggggtggatctcgaaggactacggccgcaacggggttgtgcgcaagaggattggcctctgcttcgggatccacgaggaggagtacattaacgacgttaagaatatcctcaacaagctgggcatcaagtacattgagaagatcaaggatgggtcacattccattctcatctccagcaagatcctggcttacgtcttcgagaatattctgaactgcggcatcaactgctacaataagaacatcccgccccagatgttcaatgccaaggaggagatcaagtgggagttcctcaagggcctgttccgcggggacggcgggatcgtcaggctcaacaataacaagaatctgaacatcgagttcgccaccgtttctaagaagatggcgcactcactcctgattctcctgcagctcctgggcatcgtcgcttcggttaagaagtgctacaataacaagtctacaactatggcctacatcattaggattaacggcctggagcaggtcaagaagatcggcgagctgttcgggaagaagtgggagaattacaaggacattgccgagtcatacaagcggaacatcgagccgctcggctacaagaagtccgataatttcgcgatcctggaggttaaggagatcattaaggagcattactccggctacgtgtactcagtggagacagagaactcactgctcattacaagctacggcatcctcattcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2906 - DNA, 2196 bp, Artificial Sequence
  Synthetic Construct, AT-63 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctattccgggggatgaggtcgtttgggccaaggtggacggggaggccaagctcattcctattgaggatctctacgagctctggaaggagggcagggatgttgaggtggctgctctcacggaggagggggtggtctggtccagcgtcgacagggttgctaggcacaggaggcggacaggcctggtgaagatcattacaaggactgggcgggaggtcatcgttacagaggaccattccgtgttcactgtccgggacggcaagattgtggatgtcccaacctcagagctctccgagggcgattggatcgtcctcccagctaggctgccagctggcgactcagatgagattgacgggatcaagattgacgaggatctcgcgttcctcctgggcctctacgtggctgaggggtccctgaccaaccagaaggacgctgtcaggatccacaataaggatcctgaggtcatcgaggagattgaccgcatcgttagggagaagggctgggaggggcggtactacgagagcgaccattcgtactggatcaagagccggaagctccgccagctgtgcgagaagctcggcactaaggccagggagaagaggctcgggccactcctgtcgctgaagcctgagctcctggctgctgctctgaggggctactacacgggcgacgggtcgttctctgtgaagccgcacggccgctctgccatcattgaggcgaccacggtctcaaagaggctcgctgatgagctcctggtggccctccagattctggacatcgtcgcgcgccgctacgagtgcgacgataccaagggctcgacgcggtaccgcgtgatgattaccaagtctgagtacatccgcacgttcgttgagaaagtgggcttcgcccagtccgagaagaacgagaggatccggaagttcctcgcggagaggaagtggacacgcggcaggtccgatattccgactgagctgatcgggagcccctacacctacgttgaggtggagtacatctctgacagggtggctgctgatggcgggctcatgaaggccgagctggagcatctgtacttcgacaagattaaggagatcgttcccctggatcgcgacgatgagtatgtgtacgacgtcgtggaggttaagctcgggcataatttcgttggggggcagggggttctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2907 - DNA, 2580 bp, Artificial Sequence
  Synthetic Construct, AT-64 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggcgccggagacaaagatctgcctcgctgacgggcggttcgttagggccgatgagctgttcgaggagctgaaggagcgggggcgcctggttaagtgcgacgagagcgaggaggtgtacgagctgagggagccagttggggtgtccagcctcgacaaggatgcggtggagatcgtcgagggcaagattacgcacgtgtggcgcctcaaggccgacaagctggtcgaggttgaggtgaagaacggcaggtcgatccggaccacgccagagcataagttcctggtcctcgatccttctggcgagatcgttgagaagagggccgatgagctggagatcggggactacattgtgtgcacccagaagctcgtccacgagggcatgtcggaggaggagctcaagagggaggtgttccgcaggctgggcagggacttcttcgtccatctcccggaggaggaggccgagagcgttctggagctcgcgaaggagcggggcatcaaggctctctgggagacgctggaggtggacattgaggagaactcgttctactaccagctcaggaaggggcgcatcagggccgatattctcgtcgacctggctgaggagctgggcctcgacctggctgatctgtacgacgccgtcgaggtttcatacaggtccaataccaagtccacgaagccaatcaggctcccagagccagaggacctcttctacctggcgggcctcatgttcggcgatgggtgctggaaccagctgaccaatggctccgaggccatccagggggaggtgaagcgcattgcgagcgacatgggcctggaggtgcgcgtgcgccgctacgaggggaagacagcccggatcgacttcccagagactgtgcctcgcattctggaggctctcttcgattacccaaggcggaagaaggcccaccggatccgcgtcaacgatttcctcacaagggcgcctctggactgcatcgctgagttcattcggggctacttcgacgcggatggcacagttgaggaggggcggagcgctgtttcggtgacttcggtctctcgcgagttcctggaggatctccagctcctgctccagaagttcgacgtggcttcttacctgagggagggcgatggggcttacaccctctacgtgtccggcgctaggtcactggagaggttcccagggttcagggagccagagaaggctgagaagctgaagaagctcatggagaaggcctcgtcttcagagctggagaaggtcccgatctccggcgagattctcagggaggtcaggggggacgttcccacaactcgcatgttcaactgctactcaaattacgagggcgggcaagtgggcctcaccaagtccagcctggagaaggtcatctccacgctggaggctgtcggcgttgagggggaggctctggagaggctcaaggctctggcgcgggacgatgtgtgcttcctggaggtggtccgcgttgaggaggtggagtacgacggctacgtctacgacttcacagtggaggagcatcataacttcgctgcggagggcttcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2908 - DNA, 1929 bp, Artificial Sequence
  Synthetic Construct, AT-65 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtttcggctgatactcctattctcgttaggcgggggggggaggttctgcgggttactttcgaggatctggactcatggtacttcggcgacaggggcggggagtatgtggacgtgtctgacctggaggtcctgaccgttgaccggaacttccgcgtcacgtgggctcgcgttagcaagctgatccggcaccgcgccaggaagattctcagggtgcatctggaggacggcacaatcgagctcactgggaatcacgccgtcatggttctggatgagggcgggctcagggctgtcaaggcttcggagattgaggagggctcattcctcctgtccttcgtggcggagctggacgagcagccaacagatggcgggaccgtggtcacgtccgtcggctcggggtctcgcgtgagcgacaccacgtacgagctgccagtggaggtccgcgttgagctcctgagggagctcgccgacgatggcgtgatcgaggcgagcgaggacgtgtcggtcgatctcgcttggctggcccggatttctggcgtcgagtcacgcgttaccgacgatggggtggagctcgtctgggagacaaggactggcgacctcctgccagctgatccagtgctcaagctggtcgagcggctggagtcggacctggtcgacgacctggagtcttgggtcttcgatggcagggtgtcaaaggaggcggttcggaaggtgctgtccagcgtggacgctaagaacctcaggggggatgctaggagggcttacaggatgctccggaccctggttcgctccgacgtgcatgcggttaaggtggaggacctggatgtcatggactacgatggctacgtgtacgacgtttctgttccaggcaatgagatgttcttcgccggggaggttccagttctgctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2909 - DNA, 2460 bp, Artificial Sequence
  Synthetic Construct, AT-66 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgccggggacaaagattctcacggagcatggctgctgggttaaggtggaggatctccctaagatgctgaccgatcagaagctgaaggtttacgacgtggatgagggccgcgaggacgattccgagatcaagttcgtcatggagaggggcattgaggaggacgagagggctgtggtcctcgtgaccgagtcaggcctgacgatcgaggggtccgaggatcacccagtcctcacccctgagggctacgttgagctgggggagattgaggagggcgacctcgttgtggtctacccgttcgagggcgtcgagtacgaggagaaggagggcacgatcctcgacgagtccgatttcgaggacgtggatccccaggtcctcaggtacctggaggagagggacctcatcccactgaggtggagcgatccaaaagtggggacgctcgccaggattctgggcttcgcgatgggcgacgggcacctgggcgagcaggctgggcggctcaccctgtctttctacggcgacgagcgcacgctcagggagctgaagcgcgacctggagtcactgggcgtcaaggcgaacctccatgttcgcaagcgccgctacgagatcgagacagctagcggccgctacgagggggaggctacttcggttgagctgcgggtggcgtcgcgctctttcgctctcctgatggagaagctcggcatgccaagggggcggaaggtggagaccccgtacaaggtccccgattggatcaaggaggcgcctctgtgggtgaagaggaacttcctcgctgggctgttcgctgctgacggctcggttgtgaagttcaagcggtacacaccgctccccatcaatctgactcaggccaaggtcgaggagctggaggagaacctgcgggagttcatgaatgacgtggcgaagctcctgcgcgagttcggcattgagaccacgctgtacgaggtcaagagcaagaagaacgtcgtttacaagctggccatcgtgggcgaggagaatattaagcgcttcctcggcaaggtcgggtacgagtacgatccagagaagaaggtggagggcctcgctgcctacgcgtacctcaagctgaaggagcgcgtcaagaaggacaggaaggaggctgctgagacagctgctgaggtgtacgaggagacaggctccatcactaaggcccatgaggctgtcgctgacgtggtcaacaggaggttcgtggagagggttgtgtacgacggcgggatttccagcgtgcgggtcccagaggatttccctaccttcgagcggttcaaggaggagagggttctcgctggcgggttcgtgatcgaggaggtcgttgaggtcaagggcgttgagccggagtacgacaggttctacgatattggggtttgccacggggctcataacttcattgcggatggggtcgtcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2910 - DNA, 2565 bp, Artificial Sequence
  Synthetic Construct, AT-67 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgcgcctgggacaagggttattacggcctcgggggacgtggtggagattgatgagatcgtggagcgggctgcggagacggctgtggacggcgggctgagggagggctctacagaggttactgtgggggtcaccaacgtcaggacgctggctgcttgggacggcgatctcacctctaatgacgtggtcgcggtggagaagatcgaggctccgtcacgggccgttcgcgtgaggaccaggtccggcgctgagctggttgtgagcgaggaccacaagttcctcgtggacacggaggatggcccaaggatggtcgaggctagcgagctcaagtcgggggatgagctgtactcggtgcgggagctccgcgtgtctgagaaggtcccaacatacctggagctcctgctggaggccgaggacaagttctacgtgcatcctactgaggagttcgaggaggctgtcgctgagcgctacggctccctggctgaggcttgcagggagaaggagctcccatacagggccagggaggctaaggagcgcaggtactacgagctgagcgagttcgctaggctcgctacggctgttatcgagtcggtggacgaggccacagagtacattgattacgtcactgcgggcgggcggaagcgcgttaagttctccagcccaaggccaggcaaggaggtcatgtatgtggcgggcctgatcgcttcagacgggtccgttgatacagagaggggcttcgtgatgttctcaaacactgagcgggagctgctctccgcgttcgaggagattgtcacagaggagttcggcgttgacgcctcgaagaccgagaaccagaatggggtcacgatgctgagggtcaattcccgggttctcgcgcgcgtgttcgagaggctggctgacccgaagactgtcctcaagatgccccgcgagctcgtggctgcttacctggctggctacgtcgacggcgatgggcacctgaaggatgggaagatcgtgattaccacggctgacagggagagggctggcgatctccagctgctcctgaagaggctgggggtgccaagcgtcctcagggagagggacggcgcttacgatgtcgttgtgacagggcacgacgctgctgagctcgctgaggagctcccactgaggcatcctaagaaggctgaggctgctgcttccatgtcgtctggcaggcgctcatccaggttcgaccgggtgagcaggaggttcgggaggctcctgagggaggtgcgcaggaagtacggcgtcagggcttccgatctggggagctcgtctaccatctctcagattgagtcaggcgagaggagggctacgaggaggctcgctctggagatcgtcgagaggctggaggaggtcgttggcgacgttgaggaggtgcgggagctcagggagctggctgagggcaactacgtgctggatgaggtggtcgaggtcgagacggttgagtacgagcatgagtacctctacgatgttacagtggttccagatcatactctcgtggttgagaatggcatcattacaagcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2911 - DNA, 1965 bp, Artificial Sequence
  Synthetic Construct, AT-68 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgctcgtggacaaacgctagggcggttacaaggcgggggttcgtgcatgtggatgatctcactactgatgatgaggtcatgtcggtcgacgatcagggcaggacaatctggcagcagattgacgaggtggtccggttcccgttcagcggcacgctctactcgctgggcgggagggagatcaacgctaccattacggccaatcaccgggttgtgggcctcaaccgcgagaagaccaagtgggttgagcatacaccaacttccctgcctggcaacaagatgtgggtgtacaccgctggcgaggggagcaatgaggactacccgctcaccgatacggagatcaggctcgctgtgtggggcctgacagactcgcacaggtctcccgatggccggtggactttctaccagtccggggagaaggcggagcaggtcaggaagctcctggctgacgctggcattgagtacagggagagggctaggaacaggggcatcaccgagattgatgggaaggtcctcaaggcgccgcccaagacgcagtacgagttctcgctcggcaaggttcaggagctggacgatctcctggacagggggaggagcgagctgccaacatggactctctccctgagccagaggcaggctaggctcttcctggaggagtacaggttcaccgacggcacggataccacgtcagctggggactcctacgtcctctacgtttgcaaggatcgcatgagggagcagctccagatgctggctgctgctaacggcctcagggcttccacaactgagtacaggccagggcattggaggctgaacatctctaatagggcgctctcaggcctgtacaagaataccgtggaggaggtcgcttacgagggggaagtgtggtgcctgcgggttccaaatggcaggttcttcattgaggatgggggcaagattcatctcacgggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2912 - DNA, 2007 bp, Artificial Sequence
  Synthetic Construct, AT-69 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctcgcctgctctactcctattctgactacaaatgggtggtcaactatgggggctctccaggacggggatgaggtctacgcgcctgacggccagcctaccaaggtcatcaaggcccaccccattaacctcaataggccatgcttcaaggtccggttccgcgacggccaggaggtggtcacggatgcggagcatctgtggcaggtgaacgaccggaacaatggcgggagggatcgggtcatgaccacgcaggagatcgctgacgctccatggggcgggcgctacaggttccgggtcccagttaccgagcctctccagacgccagaggctgacctgccagtggatccatggctcctgggcgcttggctcggcgacggggatgcctcgatggtctctatctgctccggcagccaggacctcgattacctgatttctagggtcgagggcctcgggctgtcacacagggttaaccgctacggctcacgcgccgcttccgtctacgtgcatggcatgagggctgtgttctcggagctcgggctcctgaagaataagcacatccccgacaggtacctgaccgcttctgtcgctcagaggaggcagctcctggctggcctgatggacagcgatgggacagtttcggatcgccaagtgactattagcatgaagaacgagaggctcatgaggcaggtgctccagctggtccggtccctgggctacagggctggcttcgggagccgcatggctaggctcaatggcagggactgcgggctggtctacgtggtgcgcttccatacaggctggggggagtcgcccttcgacatgccacgcaagagggatggctgggagcaggcgacaaagacttccgttcagaacctccggctgaatgccatcgttgcggtggagcctgtcgagaccgtcccggttcgctgcattactgttgctcatgagtcttcgctctacgttgctggggaggggttcgttcctacacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2913 - DNA, 2322 bp, Artificial Sequence
  Synthetic Construct, AT-70 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaagaatgattcgctgattttcactgatcgggggctggtcactgcggcggagctcgctgtcggggttcctgaggagcatgcggccttcacggaggttggcgtggacacatccactgggagggcgaccacgaacgctgtgtacaatggcgggaggagcccaaccaagagggctaggctcgccctgggctacgagctggaggcgacgccagagcacccaatcagggttctcagggacgatgcgctggcttgggtgcggatggacgagctccatgtcggcgatcgcgttgctctgaggaggggctcggaagtgtgggggcgctccagcctgccagaggcgttcaggtgggtcaagcctaagtacgccgcgaacctcaagctgccaaagggcctcgtgctggacgaggtcgctgctgaggcttgcggcctcctggtctccgaggggaccctcacgaagcgcctggttacagagttcactaacgccgacgcggataatgtgggcttcatctcgcgctgggcggcttctatcggcattgacctctcaaggaacgggagcgattcgattcagtacctcctgtgctccgtggtcctcagggagtggctggcttggctcggcctggactacaccagggccgctgggaagtgcatcccgcgggcggtccgcttcggcgggagggacattatgagggcgttcctcaggggcctgttcgacggggatgcttctgtcgatcccctcaagggcgttatcgagttctgcacagcctcagagaggatggcgcgggaggtccaggttgctctcctgggcctcgggattctggcttctcgccactcaaggactgtggccggctacgagcagctgtactggcgggtgaccgtcaacgacgtggccacgttcgagagggaggtcggcttctcgtctaactggaataggctcaggctgagggaggctgtggcgcgggcagagggcaggtgccggaacccgaatgttgatacagtgcccatcaacgggctcgtcgagaggctgtacaggactgcccagaagcagctctcctggtcatcccaggagggccgcatcttcgggaattacgtgcacggcgagcatgctccaagcagggctgctctggagaggatggtccagcgctgggggtcggagtgcccaaccgagtgcctccctatcgaggccttcctggagctgcctgttgccttcctgtccgtggagagcattgaggacggcgaggcggatgtcgtggatctctcagttccagagacgcatgagttcgttgctaatggggtcgtttgccataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2914 - DNA, 2289 bp, Artificial Sequence
  Synthetic Construct, AT-71 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcccagcctcaacgcggattctcagggcggacactggcgcggagtcaactctcggggagctgctggcctcgggggagcagcctctcgtttggtccctggacgagaggatgaggatggtcgctaggccgatggttaaggtgttcccctcgggcaggaaggaggtgttcaggctgaggctcgcttctgggagggaggtcgaggctaccggcaaccacccgttcctcacggtggacgggtggatcccactggataggctcacagtcggcgacaggctggctactccaaggagcgtgccagagcccgtccacacagagaggatggccgatgcggaggtggtcctcctggctcacatgatcggcgacgggtcgtgcgtccgcaggcagcccgttcgctacgcctccattgacgagcagaatctcgctgcggtgagcgaggctgctgagcatttcggcgtgacggcggtcagggacgattacgctgctgcccgcgtcaccacgctgaggctcccagctccttacaggctgtcacgcggcaagaggaacccaattgcggcttggctcgatgagctgggcctcttcgggctgaggtcccacgagaagttcatcccacggcgcgtcttcgctctccctaatgaccaggttgccctgttcctccgccatctgtgggccacagatggctccgtgaggtgggacagcacttacaggcaggcgcgcgtctactacacatccactagcaggcggctcatcgacgatgtggcgcagctcctgctcaggctgggcgttcacgggcgcattcgcagggtgaccaagccagggtacagggacgcttggcatctcaccatcgacggcgctgataaccagacggtgttcctgagggatgtcggcgttcacggggcccggggcgacgctgctcaggtggctctggctgagctggagccactggtccggaacaccaatgttgacacggtgcctaacgaggtttggaatcaggtgcgccacctgctcgcgacaaagaacattactcatcgcgagttctcggctgccatggggtctaggttctgcggctcaaccatgtggaagaggtcgccctctcgctcaaggctcgcccgcgtcgctgctgttctggacgatgcggatatcgagatgtacgctaccaatgacgtgttctgggataagatcgtcgagattacgtctctcggcgagcaggacgtgtacgatggcactgttccaggcactcataacttcgttgctcagtctatctctgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2915 - DNA, 1953 bp, Artificial Sequence
  Synthetic Construct, AT-72 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccctgcgggcacagtcgtttcggggccatcggcggaggcggctacaaggcgctggttcgagggggagctggtcgttttcactaccgctagcgggaagcagctctcgctgaccggcaaccacccagtgctcacgcgcggcgggtgggtccccgccaacctcctgaatgagggcgacgaggtggtcaggtcgacaaggccacagggcgctactccactcgttgtgcctgaccaccatcaggtgccggcgctgatcgaggatgtctgggggagcttcgctgttaatggcctccacagggtgccagctgctcctgaggacttccatggggatggccagaggggggaggtcgacatcgttggcccagatcggaccctgtggtgcggccacgacgctgctattgctcagcagcgggagcagcagttcttcacccgcaggacggagtccagcggcctcctggtggctgagtccgtcgctcagctcgttgacctgtggcaggctccacactctggctcgtctatcgggcgctcaggcctcccattcgctctgattggcgggcatggcgggggccctgtcgagaggggcctcacggttgctgctgggggctacccaggcctccatgaggccctggcggactaccggcccggcgatgctgtgctgccaccacagggggtcttcgctggctcatccgagatcgggggcgacgattgcgtgattggcaaggtcgactccacacgctgggatgctccagctctccccttcctggtggaggggagggcgggctacgctagcagggggaaggagctcttcgaccggctgactggccaggtcgagctcgatcgcatcgttattctgcggcgcgtgcagtggtccggccacgtcttctcgctcacaagctcagaggggtggcatacgggcaactcgctcatcgtctctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2916 - DNA, 2241 bp, Artificial Sequence
  Synthetic Construct, AT-73 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccctgcgggcacaccagtggacactatcgatgggccaaagcctattgagtcgctgcgggctggggatcgggttctctcgcatgacggctcgtacgccacggtggagaagctgatcgagaacacaaatgatcagccactcgtctccattagccacttcggccataaggagcctatcaggtgcacgccggagcaccccattctggtgtggacggaccgggatgtcgagacactcatcgacggcgatggggctgacccgttcaacggcttcgtgtggctggctgctcaggacgtccatccatccgatttcattgttgctactgctccactggagacccgcgagaggagggtgttcgacctcatgaatcacgtcggcgaggggacgtacgaggaggttgacggcctgatccggaaggtgaacacagatgcgaggcatcggaataagcagcgccacaggcagggcttcgtcgctgttacccgctacgtggaggagagctacgacctcggcctgatcctcgggtggtacctcgccgagggccatgtctcgaagcgctctggggttgaggatgtgaggccaacgggcgtgcatttcacactgggggctaacgagattgagaggcacgtcgagctcggcatggccttcaagcaggtcttcggcgttgacctggtgctccacactaaccattcagatcactccaccaggatggtttgcaattctaagatcgtggctagcctcctgctctcgctggctggcacggggtactcaacaaagcggctcgcgcacgaggtcatgaccgctgacgaggatttccagaggggcctgctcgtcgggctcttccgcggcgacgggtgcaccacgacaggcgggatggtcctggacctcgttaaccaggagctgatcgatcaggtccagctgctcctgaggaggctcggcattgttagcgtggtccgcacgtacacaaaccaggctggcaatccgactgggcaggtgttcgtcccaggcctgcctgggaccaacgaggagttcatcttcgacgtggataagaacctccagaattacactggcaggaaggggaccaagcggactacctaccaggttgtgcatggccgccacgtctacgggattcgggctgttgagaggactggcgagaccccaaggcaggtctacaatctgcatgtggagggcactcatacttacactattaggggggctgtggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2917 - DNA, 2031 bp, Artificial Sequence
  Synthetic Construct, AT-74 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggacacaagcgttactctcgcctcgggggatgagaagcctattcgggacatcgtggagtcaacactggaggatccgacagagatcagcgacggcttctaccaggagtcggacattgatgtgctcaccacggatggcggggctgtcgctccaggcagggctaccaaggtttggaagcggcaggctcccgagaagatgtacaggatccggacagagtccggcagggagctggaggtcactccaagccaccccctgttcgtgcagtcagagggcgggctctccccactggtcgctgacgatctcagcgagaacgacttcgtggctgtcccgagggcgctgccagctgacgatggcgacgatttcgggcagcatgtggacgatctgggctccgtcaccgctcggaagacggctgacgctgaggccgtgcgctccgaggacgccgcgacaactccagatgttatccctaacgtgggcgaccagctccgcaggattcgcacctcgctcaggctgtctcagcacgactgcggcctgccaaggtcgacgtaccagcagtacgagaggggggaccggaatccttcgcgctctaggctccagacagtcctgactgcgttcgagcggcgcatcgagcagctctccagcctgtctgacagggtggacgatggcgactcagatgccattgctgccgcgcgggacgagctcaatccatcacaggcttccctggctagcggcatggatgctaccaggacggctatcggggacgatgagaggacggaggctaggccagacggcggggcggttgctgatgctgagagggctgtggctgacgctctctgcagggcgctggctgtcgccgacgatgttgagaggctcaggtcgctggctgacggcgatatcgggtgggacaggatcgattctattgagccagtcgagcctgaggacgagtgggtttacgatctggaggtggagagcacacactcatacctctctaatgatgttgtttcgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2918 - DNA, 2490 bp, Artificial Sequence
  Synthetic Construct, AT-75 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcaattcctgcggatgagcaggtcgtggttaggcgcaatggggagacggagctgacggagatcggccctctcgtggattcgctgatggattctcgcgagaccaggtcattcgacgatcacgaggtcacgctcgctccagacggcatcgaggttccctctctgtccagcgaggagaccgttgagtggaagccgattgaggaggtgtcacgccacgagacgccagacgagctcctgaggttcgagctggagtcgggcaggtctatcagggctaccaaggctcattctttcgtcacgcgccaggagaacgaggtggtcccagttgctggggaggagctggaggctggcgactggctccctgttgtggcttcgctggacgccaccgatacgcaggagacagtggacctgaggaagtacctcccggcgggcgattactggtacacttccgtgctcgccgacggcggggctgaggctgtcccaggcgggcccgaccagctgaggaacaagagggctgctctggaggctggcgagctcgctgagcacacagcttacccagtgcagggcactgtcgggctcccagagcagttccctctggacgaggagaccgggttcttcgtgggcgcttggctggctgagggcagcctcgcggatcattacgtttccatcagcaatgtggacgctgccttccagagccgcattaggtcgttcgccgagcgcttcgatctcacggtcaacgagtacgagaatgactccgggttcgcggctggctacgatatccggctgaacggcaccattctgagcgacttcctcagggctgcttgcacggacgatggcgagaagtcgatccccgggttcgctattggcgccaatgaggcgttcctcaaggggctcctgcagggctacttctccggcgatgggaacgtgggcaccaatgcgatcaggtcgtcttcaacaagcgacaggctgactgctggcgttgggctcctgctcgctaggttcgatgtgtacgccacactcggccagcaggaggactcacgcactctgagggtcccaaagaagcacgtttcccggttcgacaaccgcatcggcatggtcggggagaggggcgctgagctggaggctctcgctgagtcagctgactccgatgggccagacgctacagatcagatccctaacttcggcgatgctctggaggctgtggctgaggctgctgacatcccacagaggcaggtcaattcggccacgaagcggcagcgcattgacaggtctcggctggctaggctcgtggctgctgctgaggccgagctggacggggagcagtccgagctggatgcgctcaggcaggctgtcacaggcgacgtcgtttgggatcggatcgagtccattgagactgtggagagcgaccatgagtatgtgtacgatgtttcagtggaggggctggagactttcacaactgcggatggggtcgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2919 - DNA, 1980 bp, Artificial Sequence
  Synthetic Construct, AT-76 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcatcggggatactctcattccgctcgctgacggcaagtcttaccgcatcaaggatctcatggactgggggacggagttcatcgtttacgcgtgcaccccaacgggcaagattgtggctgctcaggctaccgctaagctcacgaggaggaacgctccactcgtgaaggtcatcctggacaatggcgaggagatcatttgcacacccgaccaccagttcatgctgcgggatgggacttacaaggaggcccagctcctgcaggcggagacatcactcatgccattctactccaagactgacaaggatggctacacactgattactcagccttactccagcaggtggcagaaggctcactggatcattgctaggtctggcctcctggggaaggtgccaaggttcgagggccagaagacgttcatccaccatcagaacttcgacgagagcgataaccgccccgagaacctggagttcatgggcaacagggaccactcggcgtaccatcgctctctggtggagaggaatcagcactggcattccgctgagttcgaggagaagagggtcgctagcctcgctcagaaggctaagacctcggagggctaccagtactacgccgagagggggacgcggaacatcttccagtacatggagcagcagccagagcacttcaagaatgcggtcgctggcaacgggaataggggcaagcagtacctcgttgagtacaacaagacagagaagggcagggggaagtcgcaggagatcgcgaaccggtactacacctgcgagatttgcggcgtcgacgttaagacgcccatcgggctgcacaaccatcggcgcaaggagcaccagtgcaatcataaggtggtcgccgtgaacctcctgaattacaccgaggatgtctactgcctcactgttccggagtaccacaacttcgctctcaaggctggggtcttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2920 - DNA, 2070 bp, Artificial Sequence
  Synthetic Construct, AT-77 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctctcgctctggataccgctctccctacgccttcggggtggactactatgggggacgttcaggttggggatcagctctacgatgcgcacggcaggccaaccacggtggtcgctgctaccgaggtgctcacggggaggccttgctacgaggtcgagttctcagacggctcccgcatcgttgccgatgcgcagcatcagtggctgaccgagtctagggctgctcggaagtcacgctgggctgctgacaagcagtacaaccgcgccaggaaccagaatatcgtcgcgagcgttgtgacaactgaggctattgctgggaccctcagggtgggcgctgaccagagggccaatcacgctgtcctcacggctgatccactgtccggcagcgacgtcgatctgccaatcccaccctacgttctcggcgcttggctgggcgacgggcactcggcgtctgctaggatcacctgcgagacgccagagattcctatgtacctggaggcttgcgggctgagggtcgaccatcagggcgcgatgctctactccctgaagttcccagacggcgatccgaggggcagcgtccagggcgttctcaggaccatcggcgtgctgaacgacaagcacattccagcggattacctcagggcttccgagggccagaggagggacctcctggctgggctgatggacacagatggcactgtcgttaggggcgttgggtcgtgccagttcgctgtgacaaacaagcggctcgcggacgatgtctacgagctcgtggtctctctggggtacaagtgcggcaggaccacgaggagggtgcagggcaggagcccagagacatcgacttgccatatcctcaatttctcgacggtggacgatgtcttcaggctggagcggaagcacctcctgcataaggaggagaggccagtgacacgggctaggatcgccaggcggtacattactgccgttcgcccaattgagtccgttcctgtgaggtgcgtggaggttgataatacagagcatctctacctcgccggggagagcatgattccaactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2921 - DNA, 2235 bp, Artificial Sequence
  Synthetic Construct, AT-78 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctccctgaggatgcgctggttcataccgctaaggggctggtccctattcgggatgttcaggtcggggatctcgttcagacaccgctcggcttccgcagggtggtcgacaagttcgatcagggcttccaggacgtgtacgagatcgagactaacgcgacctacccacgcgctacgctcaatcacaggcaggctgtcctggaggacgctaagggcgggatcgtttggaagcatattgcttcgctggaggccggcgataggctcctgcacaacaagcaggtcctcccgggcactgttacccatctgcccgcggacttcactgagagcaggccatcacactcccggaccgccaagtcgttcgttgtgcctgagctcacggctgaggtggcttggctgatcggcttcacacatggcgacggctacgtggctctcggcaggaacaagtacgataagccgtacgggcgggttgagtggtccatgaactccctggacgctgaggtcacctcccgcatccaggctaagattgatgctgctctcgctctgttcggcctctccgctgtccacagcatcacgaagggcgagaacacagctaagagcatctgctccagcattcggctggccgagtacttccaccgccatatcaagcagccaaatattcctctcactgtgccgtcattcatcctgcagggctccgtcgacattagggctgcttacctcgctggcctgatggactccgatggggctgtgaacaataggccaccacacctcatcacatcggtgtaccggtctttcattcgccaggtctcggtcgttctctcgtctctgggcatcgccgggaggctgaccacgacatacccccagaactctaattggcaggtcaagtacaacctcacgatcccggcgctgaaggagcgctacaatgctctcatttctccccattcagccaagggcgagctcaggcaggggctgaagatgtacggcttcacggttccaggggccgtgatgcgggagacgtacacatactctgagatgagggagatgggcttccaggggtcacggacagttgacgccaactacgagcgctacgtggcggaggctgacatctccctcgatattcctgtgactgtcaagggcctggggagctacgatcacgtgcagacctacgacattgaggttgatgaggctcattgcttctactgcgatggctacctcacacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2922 - DNA, 1506 bp, Artificial Sequence
  Synthetic Construct, AT-79 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggattacgagactgaggtcgtgctggggaatggggagcggaagaagatcggggagatcgtggagcgggctattgaggaggctgagaagaacggcaagctcgggcgggttgacgatggcttctacgctccgatcgacattgaggtctactcgctcgatctggagaccctcaaggttcggaaggcgcgggcaaatatcgcgtggaagcgcacagctccaaagaagatgatgctggtgaagactaggggcgggaagcgcattagggtcaccccgacgcaccccttcttcgttctggaggagggcaaggtggctatgaggaaggcccgggacctggaggagggcaacaagatcgccacgattgaggggctctccgtgagctgggacgaggtcgcggagatcctggagtacgagccaaaggatccttgggtctacgatctgcaggttccaggctaccacaacttcctcgctaatggcatcttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2923 - DNA, 1818 bp, Artificial Sequence
  Synthetic Construct, AT-80 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgcctgagacactgattattactgagaatgggacaaaggagatcggggaggtcgtggagcggtggatgaaggagctgggcgagatcgagtacgacgatggcatttcgtactctccggccttcgagaaggttgcgtccctgaacggcgggaaggtgaagatgctcccggtccgcagggtttggaagctgaggagcccaggcaagatgatcaagattcgctcagagtccgggaagcagatcaccgtcacgccagagacaaagctcctgactatcattgacggctcgctggagtgggtggaggctcgcaagctgaagaaggggaactacgttgcggtggtcaataaggagaggagcatcgtgcctattggcgacttcctcgctaagctcctgaagttctacggggtcgagctgaacctcaatgaggctgttgagcgcgaccaggccaggaagctcctggagaccctgaagtctaagggcctctcagatgtcacgatcgagattccagagaagctccggcgcttcatcaagtgcgaccgcgtgcgctacgtggatctggttgagatgctctccagcatggagggcgagctgaaggaggaggtcatgctcctgctctccgacgtgggggatatccacgaggtcattcaggagcggctgaaggagatcggcaagattctggagagcgacgcgtcgtgggagaggatcgctgaggtggaggaggttgtgcgggatggccatgtctacgatctcacagtggagggctctcattctttcattgctaatggcttcgtggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2924 - DNA, 2196 bp, Artificial Sequence
  Synthetic Construct, AT-81 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcctccctgatgagaaggtcgtggttccctcggtcgggttcgtgacactcaaggagctgttcgagacggcttccaaggtcgtggagcgcgacgatgagaaggagatcagggagctcgacgagcggattaccagcgttaacggcgatgggaagacgggcctggtcaaggcctcctacgtgtggaaggttaggcacaagggcaaggtcatccgggtcaagctcaagaattggcacggcgttacagtgactccggagcatcccttcctcaccacgaaggggtggaagagggctgaccagctgaggccaggcgattacgtcgcggttcctaggttcatccatggcaacgaggacgagaagattttcctctcctacgtgaaggtcaagaagtctggcgaggagtggaaggagtacttctacctggcgggcaggaaggggaacatcgatgtcaatctcctgttcgttgctccaaagcgctacgtggtcgagttcctccgggggtacttcgaggagcgctccgaggtcaagggcgagagcgttatcgtggaggctcgggagctggtggagcctctcagcctggctctcctgaggttcggcatcttctctaagattcaggggtcaaagctcatcgtcaccggcaagcgcaacctggaggccttcaaggactacattggcttcaaggatgagagggagaaggccctggaggaggcgatcgagaaggtgaagggctccgaggtctacccgatcttcgaggagattcgcaggctccgcctcctgttcgggttcacaagggaggagctgggctcatacgctaagtacgagaactccgaggccccgacttacgaggagctcatggagatcctggacttcattgagagggggtcccccagcctctcgaagaagatcgcgattctggagggcaagctgaaggctgagctcagggtgctggaggaggagggcctgatcaaggacgggaagctcaccccactgggcagggagctcctggaggtctggcggaaccgcgagttcgattccaaggacgtcgattacatccggaacattgcggagacgctggtgttcatccccgttgagaatgtggaggaggaggagtacgacggctacgtttacgatctcactacggagactcataacttcattgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2925 - DNA, 1602 bp, Artificial Sequence
  Synthetic Construct, AT-82 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgcgctctactacttctctgagattcagctccctaacggcaaggagttcatcggcaagctcgtggatgagctgttcgagaagtaccatgacaagatcggcaagtacaaggatatggagtatgtggagctcaacgaggaggacacattcgaggtcatctcaattgggccagatctgtccgctaggaggcacaaagtgactcatgtctggcggcgcaaggttaaggacggcgagaagctcgtgaagatcaggaccgctagcgggaaggagctcgtgctgacgcaggaccacccggttttcgtgctcctgggcagggacgtcgctaggagggatgctggcaacgtcaaggttggggacgagattgcggtgctcaatacgcggcccgatttctcggtcctgtctccgcccgctatgccagagctcctgtctgagcctttcaattacgagctgtccagcatcggcgacgtcgcttgggatgaggtggtcgaggttgacgagattgatgccaagggcctcggggtggagtacctgtacgatctcacagtggatatcaatcataactacgttgctaatggcattgtcgtttctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2926 - DNA, 2013 bp, Artificial Sequence
  Synthetic Construct, AT-83 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcagcggggaggagacagtcgttattcgggagaatggggaggtcaaggtgctcaggctcaaggatttcgtggagaaggctctggagaagccaagcggcgaggggctggacggcgatgtgaaggtggtctaccacgacttccgcaacgagaatgtcgaggttctcaccaaggatggcttcacgaagctcctgtacgctaacaagaggatcgggaagcagaagctccgcagggttgtgaatctggagaaggactactggttcgctctcacccccgaccataaggtctacaccacggatggcctgaaggaggccggggagatcacagagaaggacgagctcatctctgtcccaattactgttttcgattgcgaggacgaggatctgaagaagatcggcctcctgcctctcacctcggacgatgagcggctgcgcaagatcgccacgctcatgggcattctgttcaacggcgggtctatcgacgagggcctcggggtgctcacactgaagtccgagaggagcgttatcgagaagttcgtgattaccctcaaggagctgttcggcaagttcgagtacgagatcattaaggaggagaacacaatcctgaagactagggacccgcggatcattaagttcctcgtcggcctgggggctccaattgagggcaaggatctcaagatgccatggtgggttaagctgaagccttcactcttcctggccttcctggagggcttccgggctcacatcgtggagcagctggtcgacgatccgaacaagaatctccccttcttccaggagctgtcctggtacctcggcctgttcgggatcaaggcggacattaaggttgaggaagtgggcgacaagcataagatcattttcgatgctgggcgcctcgacgtcgataagcagttcatcgagacgtgggaggacgtggaggtcacctacaacctcactacggagaagggcaatctgctcgccaatgggctcttcgttaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2927 - DNA, 2379 bp, Artificial Sequence
  Synthetic Construct, AT-84 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcccccctactgaggaggcggttttcaagttcggggataaggttaagatcgctactttcgaggaggtcgctaagaatttcaagttcgagcacaaggtcgagatcgacggcttcaagggggagtacagcattcccaacgacctctacgtgctgaccttcaatgatggcaaggccgagtggacccgggtcacgaagttcctccgcaggaagcacgaggggaagatccgcgtcattaagaccaagacgggcaggacgatcaggaccacgccagagcataagttcttcgtttacaaggacggggagctggtgaagaagagggctgacgagctggagccaggcgatgagctggtgctcctgtggcggttcgagtccgaggagacactcactgagatcaacctcctggaggctttcaaggacctgccacaggaggagaaggagaaggtctacgttcgggggattaaggacctcgatctgacgcctctcaaggagaagtacggcgacaaggtctactactgggcgaggcaggattcgatgccgctctctgtgttctacgagctcaacgtcgacctggataaggagttcaggctgggccgggacgctacaacttacgagctcccatctaagctgaagatcacaccttcactcgccaagctgattggctacttcgtgtcagacgggaactactccgacaaggatctccgcatcactgtgggccacgaggatgtcgagaaggagatcgttaatattctggaggagctcggcctgccatactcgttcctggagtgggaggggaagaccaagcagatcgttattggctctcgcctcctgaggctggtcttcaagcatgttttcaagatcccagagggggctccaaacaagaggctcccggagggcttcctgtccttccccttcgaggctaaggtggctctcctgagcggcctcttcaatggcgacggctacgtggtgcgcggcgagcaccatctgtcgatcgggtacgcgtccacaagcaagggcctcatcagggatattctgtacctcctggcttccctgggcattttcgcccgggtgtaccgcgtccctaaggagaagatgaagggggccaaccacgacctctacaagctgtacatcgcgggcaccgatctcgttcgcctggtggagctcctggagctcagggagggccatcgggagaagctgggcgagatcgggaatcgcaagccggcgagggtgaagaagatcgctgacttctacattgacgttgtggatgaggtcagcgaggaggagtactcgggctacgtttacgatctggaggtggagaatgaggggcatagcttcgttgctgcggatggcatcctcgtttcaaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2928 - DNA, 1569 bp, Artificial Sequence
  Synthetic Construct, AT-85 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcccaggcgatacacgcattctcgttcagattgacggggttcctcagaagattactctcagggagctctacgagctgttcgaggatgagcgctacgagaacatggtttacgtgcgcaagaagccgaagagggagatcaaggtgtacagcattgacctggagacaggcaaggtggtcctgactgacatcgaggatgtcattaaggccccagcgacggaccacctcatcaggttcgagctggaggatgggcggtctttcgagaccacggtggaccatcctgtcctcgtttacgagaacggccggttcatcgagaagcgcgctttcgaggtcaaggagggggacaaggtgctggtctcagagctggagctggttgagcagtccagctcgtctcaggataatccgaagaacgagaatctcggctccccagagcacgaccagctcctggagatcaagaacatcaagtatgtgcgcgcgaatgacgatttcgtgttctcgctcaatgctaagaagtaccacaacgtcatcatcaatgagaacatcgttacacatcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2929 - DNA, 2511 bp, Artificial Sequence
  Synthetic Construct, AT-86 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacgggggacgctaaggttatcgctaatggggagctgacaacgatcggggagctggtggagcgcatctcaaatggcaagctgggcccaacccccgtccggggcctcacggttctggggatcgacgaggatggcaagctcgtggagctgccagtcgagtatgtgtacaaggacaagaccagcgagctggtcaagatcaggacgaggctcggcagggagctgaaggttaccccataccaccctctcctggtgaaccgcaggaatgggaagatcgagtgggtgaaggctgaggagctgaagccaggcgacaggctcgctattccgtccttcctccccgccatgctgaacgataatcctctcgctgagtggctgggctacttcttcggcaacgggtacacagacagcgaggagcgcgtggtcttcgagtctaagtcaaaggagctcaggaagcggttcatggagctcactaggaagctgttccaggacgccgagatcaaggaggattccggcaaggtttacgtgtccagctcggaggttaagcgcctcgtgaagtcactgaacaaggattccatcccagagcaggcttggaaggggctcaggagcttcctgagggcgtacttcgactgcaatgctgagatcaaggataagatcattgtgtctacggctggcaaggagatcgccgagcagatttcatacgctctcgctggcctggggatcgtggctgaggtcgacgataaggggtcggtcatcatttctgacccggagaacgtttctaggttcctggatgagatcggcttctcagtcgaggagaagaaggaggaggctaaggccctgattaagaagtcgaccctcaacctgggcatctacgtggacaaggagctcatttcctacgtccgggagaagctcaagctgagcttctacgagaatgagacgatgtggtcgccagagaaggcccgcgagatcgcgtggaagctgatgaaggagatctactaccggctcgacgagctggagcgcttcaagaaggcgctctccaagagcgtgatcattgattggtcggaggtcgagaagaagaaggaggagatcagcgagaagacagggatctcggtgaacgagattctggagtacgccaagggcaagaggaagccgtctctggaggagtatgtgaagatcgcgaaggctctcggcgtggagctgaaggagacactggaggcgattttcactttcgggaagaagtacctgggctacgtgatctccgacgagattgagaccctggaggaggtcaggaaggaggagctcaagcggctgaaggagctcctgaacgacgagaagctgaagaagggggtcgcctacctcatcttcctggcgcagaatgagctcctgtgggatgagatcattgaggtcgagaagctcaagggcgacttcgttatctacgatctgcatgttccaaagtaccacaacttcatcgggggcaatctgccaactgttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2930 - DNA, 2838 bp, Artificial Sequence
  Synthetic Construct, AT-87 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacaggggacacaaaggtctacacgcctgatgagcgggaggttaagattagggatttcatgaattacttcgagaatgggctgatcaaggaggtgtctaatcgcatcgggagggacacagtcattgccgcggtttccttcaacagccgcatcgtgggccacccagtctacaggctcactctggagtccgggaggatcattgaggccactggcgaccacatgttcctcacccctgaggggtggaagcagacgtacgatatcaaggagggcagcgaggtcctcgttaagccaaccctggagggcacgccttacgagccagaccccagggtcatcattgatatcaaggagttctacaacttcctggagaagatcgagcgcgagcacaacctcaagccactgaaggaggcgaagacgttcagggagctcatcacaaaggacaaggagaagattctgaggagggctctggagctgagggctgagatcgagaacggcctgaccaagcgggaggcggagatcctggagctgatttctgctgatacgtggatccctcgcgctgagctggagaagaaggccaggatctcaaggacccggctgaatcagattctccagcggctggagaagaaggggtacatcgagcggcgcattgagggccgcaagcagttcgtgcggaagatccgcaatggcaagattctccggaacgccatggacatcaagcgcattctggaggaggagttcggcatcaagatttcatacaccacggtcaagaagctcctgtccgggaacgttgatggcatggcgtaccgcatcctcaaggaggtcaaggagaagtggctggttcgctacgacgatgagaaggcggggatcctggctagggtggtcggcttcattctcggcgacgggcacctggctaggaatggccggatctggttcaactccagcaaggaggagctggagatgctggctaacgacctccggaagctcggcctgaagccgtcggagatcattgagcgcgattcgtcttcagagatccaggggcggaaggtgaagggccgcatctacatgctctacgtggacaatgctgccttccatgccctcctgaggttctggaaggtggaggtcgggaacaagaccaagaagggctacacggttccggagtggatcaagaagggcaatctcttcgtcaagagggagttcctcaggggcctgttcggggctgacggcaccaagccctgcgggaagcgctacaacttcaatggcatcaagctggagattcgggctaagaaggagtccctggagcgcacggtggagttcctgaacgacgtcgccgatctcctgagggagttcgacgttgattcgaagatcacagtgtctccgactaaggagggcttcatcattaggctcatcgtgacacccaacgacgccaattacctcaacttcctgacacgggtggggtacgcctacgcgaaggatacttacgccaggctcgtcggcgagtacatccggattaagctcgcgtacaagaacatcattctgcccggcatcgctgagaaggccattgagctggcgacagtcactaacagcacgtacgcggctaaggttctcggcgtgtcgagggacttcgttgtgaatcggctgaaggggacacagatcggcattactagggatttcatgaccttcgaggagttcatgaaggagcgggtgctgaacggctacgtgatcgagaaggtcatcaagaaggagaagctcggctacctggacgtctacgacgttacttgcgctcgggatcatagcttcatttccaatgggctcgtttctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2931 - DNA, 2211 bp, Artificial Sequence
  Synthetic Construct, AT-88 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatcgatggcaacgctaagattattttcgagaatgagggggaggagcatctgacaactatggctgagatgtacgagcgctaccgccacctcggcgagttctacgacgagaactacaatcgctgggggattgatgtgtccagcgtcccgatctacgtgaagtccttcgacccagagacgaggagggtggtcaagggcagggtccgggccatctggaagtacgagctgggcgaggagattccgaagtacgagatccgcacacacaagggcactaagattctcaccagcccatggcatcctttcttcgtcctgacaccagacttcgaggttatcgagaagagggcggacgagctcaaagtgggcgatatcctgattggcgggatgcctgacggggaggatcacgagctcattttcgactactggctggctggcttcatcgctggcaacgggaatctcgacgattcggagagggagtacaaggcccgcgagctcctggatggcatcgagaacgggattccgcccaagatcctgaggaagggcaagaatgccgtcctctctttcatcacgggcctgttcgacgctgaggggcacgttaacgataagtcaggcattgagctcgggatggtgaataagaagctgatcgaggctgtcacacattacctcaacagcctgggcatcaaggcccgcatgagggagaagcggcgcaagaatggcatcgactacattatgcacgtggaggagtactcgtctctcctgcggttctacgagctcattggcaagcatctgcagaacaatgagaagaaggagaagctggagatcctcctgcacaagcataacggcggggcgttcgatctctcactgaacttcaatgctttcaaggagtgggcctccaggtacggcgtcgagttcaagaccaacgggaatcagatcctcgctatcattggcaacgagaaggttagcctgggccagtggcacgcgagggggcatgtgtcgaaggctgtcctggttaagatgctccggaagctgtacgaggttactaagaacgacgaggtgaaggagatgctccacctgatcgagtccctggaggttgtgaaggagatcaccattacgaacgagcccaagaccttctacgatctgacagtggataagtaccagaactacctcgccggggagaatggcatgattttcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2932 - DNA, 2328 bp, Artificial Sequence
  Synthetic Construct, AT-89 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcacaggggacactcgcatcctgacggagaaggggctgattcctattgaggagatcgtgcatgagacgggcaagaagccaaaggtggtcacacacgctggcctcaaggacatcattgagacttacgataacggggagatggaggttttccgcgtgaccacggaggacggctacgagctcaaggtgaccggggaccataagttcctggtcttcgatgagaacggcaatccaacgctcaagcctctgaaggagctcaaagtgggggactacgtctacatcctggctccagagtggaagggcggggagtatgtggagctcgatacaaacatcgagctgaagggcaaggggtacaacgttaatctgccctcgaagctcgacgagaagctggcgtacctcctgggcatcatctacgctgatgggcacatccgccattacttcgagaacggcaagcgcaagaactccaagatcgagatctacctccaccaggacgagaccgagatcaaggagaaggtgaagaggtacttcaaggagatcttcggcattgagccaaaggagttcctcaaggaggagcagcataaggtcatcctggttattccttccacgaagattgtcaagttcctggagatcaacggcctcctgaaggacaagagcgagaatattcgggttccggaggctatcttccgctcccgcccatctgtgatcgctgcgttcctggctggcttcttcgacggcgatgggtcgatcgatcagaactaccggatcgccttcaagtccattagccgcgagttcatcaaggaggctcagctcctgttcctcgccctgggcatcgtgacatccattcaggagtacaacccgcccaatccaaacaataagacagtttacactctccgggtgcagactcgcgacatgaagatcaaggcgttcaacgtcctcaaggagagcgttaagctgtcgaagattatgaaggaggctatctctaagctggaggagaacggcaagaataagaagttctcattcccgttcaacgccatctaccacattaaggaccccaagatcagggcgaagattcagcgggattacaagatcctctcatacaattccaaggtgacccatagggccttcatcaacaatattctcaagctgaaggaggagctcggcctggacgatgaggaggtcaagtacttcgagatgctgagcaagctctacccaaccaagatcacgaagattgagcctctggggaaggcgcacgtctacgatctccaggttgaggatgttcatctgctcacaggcaatggcatctacacaagcaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2933 - DNA, 2160 bp, Artificial Sequence
  Synthetic Construct, AT-90 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggtcggggagacaaggattctgacgcctgagggctacatcaaggctgaggagctgttcaagctcgccaaggagcggggcaagatggaggccatcgctgtggagggcattgctgagggcggggagccatacgcgtactctctggagatcctcctgcctggcgacaagcaggtcaagtacgagaccgttcacgggaacgctgtggaggtcgccgatccggtttcagtgcccgcctacgtgtggaaggtcggcatgaaggaggttgcccgcgtgaggacaaaggagggctacgagatcaccgccacgctcgaccataagctgatgactccggagggctggaaggagatcaaggacctgaagccaggggataagattctcctgcctaggttcgaggtggaggaggacttcggctccgagagcatcggggaggatctcgcgttcgtcctgggctggttcattggcgacgggtacctcaacgttaaggataagcgggcgtggttctacttcaatgctgagaaggaggaggagatcgcctggaagatccgcgagattctggctaagaggttcgagatcaaggccgagccacaccgctacggcaaccagattaagctcggcgtcagggggaaggcgtacgagtggctggagtccatcgttaagaccaacgagaagaggatcccggagattgtgtaccggctcaagcccaatgagattgcctcattcctcaggggcctgttctccgctgacggctacgtggacaatgatatggctatccgcctcacgtcgaagtctcgggagctcctgcgcgaggtccaggatctcctgctcctgttcggcatcctgtccaagatctacgagaggccgtacaagcgggagttcaagtacaccacgaaggacggcgaggagcgcacatacacaactgaggggtactacgagctcgtgatcgcgaactactcccggaagatcttcgctgagcgcattggcctggaggggtacaagatggagaagctcagcctggagaagatcaaggtcgacgagcccattgtcaccgttgagtcggtggagatcctcggcaagaagctggtctacgacttcactgttccagagcatcacatgtacatttccaatgggttcatgagccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2934 - DNA, 2322 bp, Artificial Sequence
  Synthetic Construct, AT-91 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgcctgggtcaaaggtcctcacggagcatggctactggctgaaggtggaggagctgccggagaagttcaagctgcagggcgttaaggtgtacaacctggacgagggccacaacgatacaagcaatgttgctttcgtggctgagagggaggtggagactggcgagatggccgtccgcgttaccacggagtccggcaggatcattgaggggagcgaggaccatccagtcctgacccctgagggctacgtttacctcgggaacctgaaggagggcaatctcgtgattgtctacccgttcgagggggttgagtacgaggagaggaagggcgtgatcctcgacgaggatgcgttcaaggacgaggatccccaggtgctctccttcctgagggagaagggcctcgtcccactgcgctgggacgatccccgcatcgggacaattgctcggatcctgggcttcgctttcggcgacgggtacctcggggagatgggcgggaggctcacactgactttctacggcaaggaggagacgctccgggagctgaagaaggacctggagcgcctgggcatttcggccaacctctacgtgcgcgagtctatcgagacaactagcggccactcggaggggaagtccctcagcatcgagctgcgcgtcacatcgaggtctttcgcgctcttcctggagaagctcggcatgccgagggggaagaagactgagaaggcgtacagggtgccaggctggatcctggaggctcctctgtgggtcaagaggaacttcctcgctgggctgttcgctgctgacggctcgattgtcgagttcaagggcaacaccccgctccccatcaatctgacgcagtcaaagtccgacgagctcgccgagaatctggtggagttcctcggggatgtcgccaagctcctggcggagttcggcatcgagaccacgctgtacgaggttaagtccaagaagggggtgacctaccgcctctctattgtcggcgaggactcaatcaggacgttcgttgagcggatcaattacgagtacgatcccgagaagaaggtgaagggcctgattgctgccgcgtacctcaagctgaaggagaggatcgtgaaggaggcgcatgaggctgtcaaggacgatttcccaaccttcgaggagttcgctaaggagaggggctacgagggcgggttcgtcgctgagaaggtggtcaaggtcgagagggttaagcctgagtacacgaagttctacgatattggggtttaccatgaggctcacaacttcattgctaatggcatcgtcgttcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2935 - DNA, 2301 bp, Artificial Sequence
  Synthetic Construct, AT-92 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggacactctcgtgctgacaaaggagttcgggctcatcaagatcaaggacctctacaagattctggacggcaaggggaagaagacagtgaacggcaatgaggagtggacagagctggagaggccaatcactctgtacggctacaaggacgggaagatcgtcgagattaaggctacccacgtttacaagggcttctccgccgggatgatcgagattcggacccgcacgggccgcaagattaaggtcacgcccatccataagctcttcacaggcagggttactaagaatgggctggagatccgggaggtcatggccaaggacctcaagaagggcgatcggatcattgtggcgaagaagattgatggcggggagcgcgtgaagctgaacatccgcgtcgagcagaagaggggcaagaagatccggattccggacgtcctcgatgagaagctggccgagttcctcggctacctgatcgctgacgggaccctcaagccaaggacggtggccatctacaacaatgatgagtctctcctgcgcagggctaacgagctcgccaatgagctgttcaacattgagggcaagatcgtcaaggggcgcacagttaaggcgctcctgatccactcaaaggctctcgtggagttcttctccaagctgggcgtcccgcgcaacaagaaggccaggacttggaaggtcccgaaggagctcctgatctcagagcccgaggtggtcaaggcgttcattaaggcttacatcatgtgcgacggctactacgatgagaacaagggggagatcgagattgtgaccgctagcgaggaggctgcttacggcttctcgtacctcctggctaagctggggatctacgccatcattcgcgagaagatcattggcgacaaggtctactacagggttgtgatttccggcgagagcaacctggagaagctggggatcgagagggttggccgggggtacacgtcgtacgatatcgtcccagttgaggtggaggagctctacaacgctctgggcaggccttacgctgagctgaagagggcgggcatcgagattcataattacctctcgggggagaacatgtcttacgagatgttcaggaagttcgcgaagttcgtcggcatggaggagatcgctgagaaccacctcacccatgttctgttcgacgagatcgtggagattcggtacatctccgagggccaggaggtgtacgacgttactacggagactcataatttcattgggggcaacatgcctactctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2936 - DNA, 2961 bp, Artificial Sequence
  Synthetic Construct, AT-93 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcgccagatactatggttcgcactactaacggggacaagccaatcagggacatcgcggtcggggatcagctcttcgatcacgaggacaggccagtgcagtgcctcgctgctgaggctatccagacctcccggatgatgaaggttacctacacgggctacaacagcgtgtcgaagtccagcttcacatgcactccagaccacatcatgaccctcgttgcgtacggggtgaagcctttccgccattctaactcaaatagggtgacctggtggacgaggtgcgacaggacggagctgggcgctgatgctgtcgagatcaagtgggatgctgccatgcacgacctctacacagagtaccgcgagcagctgggcaggaggccaactgacgctgaggtccggaagtacctcaaggctatcaccagcacgcgcgtggtcccagattcggaggacgatgactctcagagggtcgaggagacgtaccagtcgcccgttctcattaagctcctggcgaagctgaaggctatggatgtggacgtcgatggcgaggacgagtctgttgtgctcatgctcctgcagcagcacatggaggactacctggagcacatgatcccagagcctgaggatatttccgacgaggataacgatgacctcatcattgacctggatacaaataggaagcggaagatcggcacaatttctactctgtcgtctcgcatctcagacaagactttcaggcagtccccgagcattaagtcatcccccgtgaactctcagcagcagtcacagaatgaggcttcgcagtctaccgtcccgacgtacgcctcggttctcaccgaggatgaccaccgcgagatgttcgcgccagtgcggtcaaagctggctgtccgcgaccctaagtgcaagtgccagaacctctcctgcaagggcctgaggcgcgtcagcacagttttcgagacttcggagcaggctgacctggctctggagctcctgagcggggatcactaccgcgtcgttgacccatgcgccgtgcaggatatggaggtcttcacaatgactctggaggagtaccaggctacctgcacggctcctatgacgcagcataagtccaagctgcgcctctacaggagcccgctcaggttccagccataccagggctcagtgtccccagtcccaatcgacccgttctggttcgggttctggctgggcaacgggaccaagaacaattccgagattacaagcactgatcccgaggttgaggtgtacacgcaggcgctcgtggataggctgaatagggactcgatcccaccaggcaaggctccactgaaggtctctaagtacaagatcgacattggcaccaagcacgtgtacaagggggaggagatcaagaccacgaaggtcgcccatcgcctcagggtcatgagcaccgtttcgaacctggacaagacgcactggaatccagtgcatgatggcctgagggagctcggcctcctgggggacaagtccggcgggatccctgactgctacatgaacgcggatgagaatacaaggctggctgtgctcgccggcctgattgagtcagacggctggctctcccacgggctgaactgctacggcttcgggcagtacacctacgagctcaagaagctggtcgaggacgctcggaagctggctctctcctgcggcatccagtgcaaccccattttcgagaggaagaatggcaaggatcggccagagcctgggtggttcttctacatgggcaggggggtcgagaagttccagccacatctcctgctccctcggaagcgcatgaccatcccgttcacaactagcaagaacagggacgttcggccattcgacgtggaggatgctggcgacggggagttcaggctcattgaggtttcaggggagctcttccagctcgcggataggactgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2937 - DNA, 2733 bp, Artificial Sequence
  Synthetic Construct, AT-94 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgctaaggggacactgctgctgcgctacgatgggacaaaggtggaggtggagaatgttcgggagggggatctgctgctgggcccagacggcgggcctaggagggcgttcaacattgtgggcgggagggaccggctctacaggatcaagatggagggcgggaaggaggatctggtggtcaccccaaatcacatcctggtcctccatcgcgagaagagggacggcgtcgataaggtttacgctaggccattcgctctcccactcctgcaggaggacgccaccgacgatggcgaggatctgtcggagatctctgcgattgagcacttcgacaccatggagatcacggctgctgacttcgcttccctcgatccgaacgagcgcaagctgtacaggctcttcacgagcccaggctacgagctgaatgggaggccagtgcccattgacccgtacttcctgggcctctggctgggggatcgctccaggaccaagtccagcatctacacgaaccacgaggaggagatccgggagttcattgcggaccatgctgccgagctcgatctgcagctcgtgtcatacgtctccaatcgcccatccctcgcggctatgaagaacggcaatcagctgcctctcaggcaccaggctaggcagacgatcaggaagcagcgcattgccgcgaagagcatcacacagccaggcggggctaggtcgtcttcataccctgccaccaacggcgggctgtccagcaatacagtgactagcctccactcgcgggagcgccatccactgtccgagtcgtctgctgccgcgacgatgaacctcctgccacgctccacaagcgtctcgacttctgttgctgcccagcctaagtcatccatgagcacattcatcactgacgctattctcccttcggagagctcgaacatctctgtcatttcagattccggcatcgagattagcaagtcttcaaagatgctgtcggaggaggaggccgacctggatctcttcgacattgattcggaggacgaggagatcgaggacctcgatgagaagaagaacgttagcaatgtggacgagttcccgaagcggcgcaggatccactacctgaggaccggctgccggacgtacggggagctctgcccaggcgaggaggaccagatcctggaggatattgttggcaggccagacgggaccacgtctgtggagtcactcctgctcgctctggaggctctggggctccatacctgcggcacgaacgacagcgggtcggataagaagcggatcccctcagtgtacatgaagaactcccgcgccgtgcgcctggctctgctcgctggcctcatcgactctggcgggtggtatgtggattcagagaacacattcggcttcagccagactgaggactctaattcaaccctgatctgggatgttgtgaccctggctaggagcctcggcttctccgtcagcacaaagcggcgcatgactcacaagccgaccaggacgcagcataaggcgcaggagttcgctcagatttcgggcaacgtcgcggagatcccatctctgctcgctagggagaggggcgttgagaggccaatctcccaggcgcacagcttcaagatcaaggacattcagctggagacagaggccactgagtgggcggggttcagggtggatcaggatcagctctacctcaggcatgacttcctcgttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2938 - DNA, 1497 bp, Artificial Sequence
  Synthetic Construct, AT-95 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgctaaggggacaaggctgctgcgctacgatgggacagagatcaacgtggaggacgtgcgggagggggatcagctgctcgggccagacggcgagccaaggagggcgttcaacatcgtttccggcattgaccggctctaccgcgtgaagatcggcggggagaaggaggatctcgtggtcaccccgaaccacattctggtgttctacagggagggcccatccgatgggcctgagaatgcggagcggcagacagtcgagatcactgccgcggagttcgctaccctcagcacggaggagcgctccctgtacagcgcgttcacctcgccagctgtcgagaagggcgctgaggggtcagctgctcagatgcattccttcaaggttgaggacatttcgctggagtctgagaagacggagtgggccggcttcagggtggataaggatcagctctacctcaggcatgattacctcgttctgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2939 - DNA, 2115 bp, Artificial Sequence
  Synthetic Construct, AT-96 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgccagattcgctcgtggtcgtcaatgataaggttcaggagatcggcaagctgacagaggagtgggggcgggaggtcgggttcctggagtactccagcggcatcttctacgctccgtacctcggcagggggatttcactggacctcgttacagggaaggtgaagccgtctgtggtctcaaaagtgtggaagctgaagtcccccgaggagctcgtcaccatcaagaccattacgggcaaggagatcacagtgactccagagaccaagctcctgacgttcaacgggacactggagtggaaggaggcgggcaagatcaagcctggggattacgtgctgactgtcaagaagctccacatcaatggcaagcaggagaccctggacgagaagctcgcctacaagagggggctgagcctctcggatccactggagttcttctcctcctccgagaggactatctccgcgtacctgaagggcattttcgacaaggtcggcaggctcgttggggataccgccgttatcaaggtggacaaggatatggcgaagaggctgcagatcctcctgctcaggctcggcattgtctccagcgttgacgagacgggcaaggtcatcatcgggcgcgagtacatccagaagattctgggctacaacgtttccgttgtgacgcacgaggtcgagctcttcagggagttcatcgccgagatttccaagttctacggcacaagcgaggaggacgtctactcgtctctgcatgagaagggcgagctcgatatcgggactgtcccagttgagctgcctgagggcctccgggaggagatcaatcgcgagagggctacgtacagcgagctggtgaagatcgcccaggagattaaggacgagaagctgtacaacaagctcgcgtggatcctgtcggaggtcacggaggaggaggctaagattaaggagaaagtgaatacactcaaggtcatcctgtcatccgatctcattccggagcgcgtggagtcggtcaagatcattaagtctccgtacccctacgtgtacgatctcacagtggagggctctcattctttcattgctaatggcttcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2940 - DNA, 2175 bp, Artificial Sequence
  Synthetic Construct, AT-97 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgctgccggaggagaaggtcgtgctgcctgagatcgggctggttacgctgcgggagctgttcgagctggctaatgaggtcgttgtcaaggacgaggagaaggaggttcggaagctgggcaagatgctcacaggggttgatgagcgcggcaacgtgaagctcctgaatgccctctacgtgtggagggtcgcgcacaagggcgagatgatccgggttaaggtgaacgggtggtactccgtcaccgttacgccggagcatcccttcctgacgaatagggggtgggtgaaggctggcgagctcaaggagggggactacatcgctattccgcgcagggtctacggcaacgaggatctgatgaagttctcgaagatcgccaaggagctcggcattaagggggacgagaaggagttctacctggccggcgcgtctctcgatatcccgattaaggtgctcttcctggctccctccaagctggtcagcgccttcctccgcggctacttcgacgcgaagggggtggtcagggagaactacatcgaggttccactgttcgaggatctccctctcctgctcctgaggttcggcatcgtctcgcggattgagaagtctaccctcaagatctcaggcaagcgcaacctggagctgttcaggaagcacgtggggttcacggactccgagaaggctaaggccctcgatgagctgatctccaaggccaaggagagcgagaggtacccaattctggaggagctgaggaggctcggcctcctgttcgggttcacacggaacgagctgcgcatcgaggagaatccaacttacgaggtgctgatggagatcctggagcgcattgagaggggctcacctaacctggcggagaagatcgctgtcctggagggccggattaaggaggagaactacctgcgcatcctggaggaggagggcctcattgagaatgggaagctgaccgagctcggcaaggagctcctggaggtctggaggaaccgggagttcgactcgaaggacgttgattacgtgaggaacatcgtggagaatctggtcttcctccccgtcgagaaggttgagcggatcgagtacgagggctacgtctacgacgttactacggagactcataatttcgttgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2941 - DNA, 2580 bp, Artificial Sequence
  Synthetic Construct, AT-98 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctctctacgatttctcggttattcagctctctaatgggcggttcgttctcatcggggatctcgtggaggagctgttcaagaagtacgccgagaagatcaagacctacaaggacctggagtacattgagctgaacgaggaggataggttcgaggtggtctcagtctccccggacctcaaggcgaataagcacgttgtgtctcgggtgtggaggaggaaggtccgcgagggggagaagctgatccgcattaagaccaggacgggcaacgagatcattctcacacgcaatcatcccctgttcgccttcagcaacggggatgtcgttaggaaggaggctgagaagctcaaagtgggcgacagggttgccgtgatgatgcggccgccctcaccacctcagactaaggcggtggtcgacccagctatctacgttaagatttccgattactacctggtgccaaacggcaaggggatgatcaaggtccctaatgacggcattccgcccgagaaggcccagtacctcctgtctgtgaactcataccccgttaagctcgtgagggaggtcgatgagaagctcagctacctggctggggtcatcctgggcgacgggtacatttccagcaatggctactacatctcggcgaccttcgacgatgaggcgtacatggacgctttcgtctccgttgtgagcgatttcatcccaaactacgtgccttccattaggaagaatggggactacacaatcgtcactgttggctctaagattttcgccgagatgctctcacggatcttcggcattccgcgcgggaggaagtccatgtgggacatccccgatgtcgttctcagcaacgacgatctgatgcgctacttcatcgccggcctcttcgacgcggatggctacgtggacgagaatggcccgagcatcgtgctggtcaccaagtcggagacggtcgccaggaagatctggtatgtgctccagcggctgggcatcatttcgacggtttctcgggtgaagtcgcgcggcttcaaggagggggagctcttccgggttatcatttctggcgtggaggatctcgctaagttcgccaagttcatcccactgaggcactcccggaagcgcgctaagctcatggagatcctgcgcacaaagaagccttacaggggcaggcgcacttacagggtcccaatctcgtctgacatgattgctccactgaggcagatgctcgggctgaccgtggctgagctctcaaagctggcctcctactacgcgggcgagaaggtcagcgagtcgctcatccgccatattgagaaggggagggtgaaggagatcaggaggtcgacgctgaagggcatcgctctcgctctgcagcagattgctaaggatgtgggcaacgaggaggcttgggtcagggctaagaggctccagctgatcgctgagggcgacgtctactgggatgaggtggtcagcgtcgaggaggttgacccgaaggagctgggcatcgagtatgtgtacgatctcacagtggaggatgatcataactacgttgctaatggcattctcgtttctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2942 - DNA, 2217 bp, Artificial Sequence
  Synthetic Construct, AT-99 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcgggggaggaggttattctcattgagaaggacggggagaagaaggttttcaagctgcgggagttcgtggacgggctgctgaaggaggcttctggcgaggggatggacggctcaatccgggtggtctacaaggatctccagggcgagaacatcaagattctcaccaaggatgggctggtgaagctcctctacgtgaaccgcagggaggggaagcagaagctcaggaagatcgttaatctggagaaggactactggctcgccctgaccccggagcacaaggtctacacgatcaagggcctgaaggaggcgggggagattaccaaggacgatgagatcattcgcgtcccgctcacgatcctggacggcttcgatgttgcggagaagtccattagggaggagctggagaggctgagcctcctgcccctcaactcagaggattccaggctggagaagatcgcgggcattatgggggctctcttcggctcgggcgggatcgacgagaacctcaatacactgtctttcgtgtccagcgagaagaagactatcgagcagttcgtcaaggctctcagcgagctgttcggcgagttcgactacaagatcgaggagaaggagaactccatcatcttccgcacctgcgataagcggatcgtgacattcttcgctactctgggcgccccagttggggacaagtcaaaggtgaagctcaagctgccatggtgggtcaagctcaagccttccctcttcctggccttcatggacggcctgtactcgtctaaccgcaatgataaggagatcctggagattacccagctgacggacaacgtggagacattcttcgaggagatcagctggtacctctcgttcttcggcattaaggccgaggcggaggaggacgaggagaaggataagtacagggctcggctcactctgtcatccagcatcgacaacatgctgaatttcattgagttcatcccgatttcgttctctcccgccaagagggagaagttcttcaaggagatcgagaagtacctggagtactccattcccgagaagacggaggacctgaagaagcgcgtcaagagggttaagaagggcgagcggcgcaacttcctggagtcctgggaggaggttgaggtgacctacaatgttactacggagacaggcaatctgctcgctaatgggctcttcgttaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2943 - DNA, 2589 bp, Artificial Sequence
  Synthetic Construct, AT-100 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcacaggggacactaaggttatcgctaatgggcagctgttcgagctgggggagctggtggagaagctctcgggcgggcggttcggcccaacgccagtgaagggcctcaaggtcctggggatcgacgaggatggcaagctccgcgagttcgaggttcagtatgtgtacaaggaccgcaccgataggctgatcaagattaagacgcagctgggccgggagctcaaggtgacaccataccaccctctcctggtcaaccgcgagaatggcgagatcaagtggattaaggccgaggagctgaagccaggggacaagctcgcgatcccgtcgttcctccccctgattaccggcgagaaccctctggctgagtggctggggtacttcatgggctctgggtacgcttacccatcgaactctgtgatcaccttcacgaatgaggaccctctcatccgccagaggttcatggagctgaccgagaagctcttcccggacgcgaagatccgggagcgcattcatgctgatggcacgcccgaggtctacgtggtctccaggaaggcttggagcctcgttaactcaatctccctcaccctgattccacgggagggctggaaggggatccggtcgttcctgcgcgcctactctgactgcaatggccggatcgagtcagatgctattgtgctctccacggacaacaatgatatggcccagcagatcgcctacgcgctggcttcgttcgggatcattgcgaagatggacggcgaggatgtcatcattagcgggtcggacaacatcgagaggttcctcaatgagattggcttctctacacagtcaaagctgaaggaggcccagaagctcatcaggaagactaacgtgcggtctgacggcctgaagatcaattacgagctcatttcatacgttaaggacaggctccggctgaacgtgaatgataagcgcaacctgagctacaggaatgcgaaggagctgtcgtgggagctcatgaaggagatctactaccggctggaggagctggagcgcctcaagaaggtcctgtccgagccgatcctcattgactggaacgaggtcgccaagaagagcgatgaggttatcgagaaggccaagattcgcgcggagaagctcctggagtacatcaagggcgagaggaagccctccttcaaggagtacatcgagattgccaaggttctggggatcaacgtggagaggacaatcgaggctatgaagattttcgccaagaggtactccagctacgcggagatcggccggaagctggggacttggaacttcaatgtgaagacaatcctggagtccgacactgtcgataacgttgagatcctggagaagatccgcaagattgagctggagctgatcgaggagattctgagcgacgggaagctcaaggagggcatcgcgtacctgattttcctcttccagaacgagctctactgggatgagatcaccgaggtcaaggagctgaggggcgacttcatcatctacgatctgcacgttccaggctaccacaacttcattgcgggcaacatgccaacagtcgttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2944 - DNA, 2133 bp, Artificial Sequence
  Synthetic Construct, AT-101 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcatcctgacactctcattctcacatcacagggggttcgcaagatcaaggagctctcgcgggagggggaggttttcgctctcgacttcaacctgaagctctccaaggcgaagtacaggctcctggagcgggacgctgatgagcagatgtacaaggtgaccctcctggacggcacggagctgtacctcacagccgatcacccagtgctcgtctacagggagggcaatctggctttcgttcctgccgacaagctccgggagacggatcatgtggtcctggtgctcaacaagtctgctcgggacaattacggcttcctcgatctcctgctggagattactgactcacaggaggattacgccatcctggagaacggcgagaccctgtcgctccactctctgaagatgctcgtggagcgcggggagatcaaggacattgcggttgtgggcttctcgcataacaatttcgggaaggtcatgctcagggatgagctgtggtacctcatcggctacctggctgggaagggcggggagatcaagggcaacggggtcgttatttccagcaggacgaaggagatcgtcggcctgacaaagagcctcaacatcgacctgattgagaccgaggaggggatcgtgctctcaaataagtccttcgtccggctgctccacctgatccattacacgccgcgcgtccccgaggtttacggcatcattaacaatacagagtggctcaaggccttcctggcgggctactacgacgccactctgctggaggggctgaccctggaggctctctacaagatcaaggtctacctgcagctgctcggcatccgcgcgaagattgaggacaacaagctcaaggttcacctggaggatctccagcggttccgcgagctgctcggcaagttcagccgccgcaagctctacgtggagacttcgcaggttccggtgttcaccgacttcgatgagcgctcctacgacttcccaaggatcctgggcggggatatctacatcattggcatcaagagcattgagaagttccattacaaggggaaggtctacgatctcgtcgtggagaactaccacaacttcattgctaatggcattgctgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2945 - DNA, 1794 bp, Artificial Sequence
  Synthetic Construct, AT-102 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgcctgatactctcattaacacagacaacgggcgggtggagatcggcaagttcgtggaggagtggatgaaggaggtcggggagatttcggaggagggcatctcttacgccccgtgcttccgcaaggtcgagaccttcaaggacgggaagattgttgagagcccaatccgcagggtgtggaagctccgggctcctaagaagctggtgcgcattaagacagagaacggccgcagcatcgccctcacaagggagactaagctcctgactatcaatgatggcgagctgtcgtgggtcgaggctggggaggtgaaggtcggcacctacgttgggacggtgaagtcagagaaggacgtgattccaggcgctgggaagaccatcagggatgtctccaagctctacaacatggagatggaggtcaaggactacctgacgagggaggaggttcggaaggcgattgagaagctggaggagatcatgaacccgatgaatatcaagattcccggcgtgcaggagtcctacgaggagctcctgcggaagctggagaccacgaacgatgagcgggttcgcaatgagacactcatcctcctgtccgacgtgagcgatgcccacgagctggcgaaggagaagatcgagaagattaaggagatcgtgaactccgaggtccattgggagaaggtcaccgaggttggcgaggtggacggggtcgagtatgtgtacgatctcacagtggagggctctcataatttcgttgctaatggcttcatcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2946 - DNA, 2346 bp, Artificial Sequence
  Synthetic Construct, AT-103 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgctgccggaggagcgggttattctgcctgactacgggcctattactctggaggagctcttcaatatgacaaaggagacagtgttcaaggacgaggagaaggaggtccggaagctcggcatccgcatgccagtggctggcgtcgatgggcgggtgcgcctgctggagggcccctacgtttggaaggtgcgctacaaggggaagatgctcagggtcaagctgaaggactggcacagcgtggctgtcacaccagagcatcccttcctcaccacgcggggctgggtgcgcgctgaccagctgaagcccggggattacgttgccgtgccaaagatcctccctgggaaggacgataaggagaagttcctccagtatgtgcacgagaagctgaagggcaaggttcatattaagctgccgtccagcgacgaggagtgggagacattcttctacttcgccggcactatcttcgggcgcgagaactcggtgaatccagagggcctcacccacgaggtcaaggctctcctggagctcttcaaggttctgttcgagtacccgagggaggtcctccgggttctgttcatggccccggtgcgctacgtggcgaacttcctccgcggcttcttcgacattaacggctacgtcaatggggaggagctgagggtcgaggttaggggggctccacatgaggttctggaggagctctccctgatcctcctgaggctgggcatcgtgtccaagatctaccctacgagcctggctatttcgggcaggaggaacctggagctgttccggcgctacatcgggttctcggagaagcagaaggccaaggagctggagggcatcattaggcggtctgagaactcagagtcctacccaattttcgaggagctgcgcaggatcaggctcctgttcggcttcacccgggcggagctctcgtctacgatcccactgtactctaagtacgagtcaaaggaggctccttcatacgagatcctcatgaagattctgaatacaatcgagaaggggtctaaggacctcaacaagaagatcactattctggagggcagggtgcgggatcacgagtacattgaggagttcaagcgcgagggcctgatcaaggacgggaagctcaccgagctgggcaaggagctcctggaggtctggcgcaacagggagttcgactccagggatgtcaactacctccggaatatcattgagaacttcgttttcctgccggtggagaagatcgaggagttcgagtacgatggctacgtctacgacgttactacagagactcataatttcattgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2947 - DNA, 2439 bp, Artificial Sequence
  Synthetic Construct, AT-104 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggactctaaggtcctgacggagaaggggccagtggagattcggcatctcaattcgggcatgatcgtgggcatcaatggcttcaagagcaggttcgtcaagttccaggagctgcaccaggtcaagtaccaggagtacggggttaagatccggacccagctcggcttcgaggtgaagtgcaccagggagcatcggttcctcacgattgacaagaacggcgagctgcgctgggttgaggcttggaggctcaaggagggcgattacgtggggatcattcgcaagctgccgtctcccaactcaaaggttctcatcctggacttcctcccggagtcgacgtacctctggctgaataaggagttcctcaagaagctgaaggtctctatcaaggagaagttcgggtcaattaagaactacgccaaggagcggggcttcaattccagctacctggtgaagcagctcaacgggctgtccccattccgctggggcaggctcagggttatcctgaatgatgtgtcgatcgagatttctcgggacgatatcgagcgcattacatcacgcaggggcaagtactccctcccaccagagctgactcctggcatcgctaggctcctggggttctggatggctagcggctcgctcaaccgcaataccctgatcttctactcgcaggacaagaagattctggagcgctacgaggatctgtgcaagcgcgagttcagggtcaaggggcggatcaaggcccaggacaagggcacgtacatcctggagattccctcgtctctcctgtctttcgtcttcaagaacctcgcgcgcccaaagctggaggttccaccgatcatctacatcctgcctgagaagcacaaggaggagttcctcgctggctacttcgacggcaacgggttcatcaagattgagaatgggaggatccattccctcggcttcttcgccttcaaccgcaagttcgcggaggggatcagggatattctcctgcagctcggcatcctgtcatccattaatgagcagacattcgaggtgagcatcattgagggcgagaagttcctgaagatcgtcaactcctggcgcagcaattactacaaggagtgggaggacgtgatcccgaacctggagaagaggctgaaggagattgaggagaagctcggctaccccgggacttacaatcggcgcgagatcaggcggtccgagctcaaggcgatcattaagctgtacgagaaggtggctcgggagaggggcctgaacgacgtcctcaaggagctgagctacctcaaggagctgtcggagggcgacatcttcttcgataggatcaccagcattgagccagtgtacctcgatgtcgcgtacggcatcatcaactcagagacaggcaactacgtggttaatggcttcgtttcaaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2948 - DNA, 2436 bp, Artificial Sequence
  Synthetic Construct, AT-105 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcaggggaggaggttattatcgtggagaagggcaaggaccgcaaggtcgttaagctgcgggagttcgtggaggacgctctcaaggagccatccggcgaggggatggacggcgatatcaaggtgacatacaaggacctgcgcggcgaggatgtcaggattctcactaaggacgggttcgtgaagctcctctacgtgaacaagcgcgagggcaagcagaagctcaggaagatcgtcaatctggacaaggattactggctcgccgttacacctgaccacaaggtgttcacttctgagggcctgaaggaggcgggggagatcacggagaaggacgagatcattagggtcccactcgttatcctggatggccctaagattgcctcaacatacggcgaggacgggaagttcgacgattacatccgctggaagaagtactacgagaagactggcaacgggtacaagcgcgccgcgaaggagctgaatatcaaggagagcaccctcaggtggtggacgcagggcgctaagccaaactcgctgaagatgatcgaggagctggagaagctgaatctcctgcctctgacctctgaggactcacggctggagaaggtcgccatcattctcggcgcgctgttctcagacgggaacatcgatcgcaacttcaataccctctccttcatctccagcgagcggaaggccattgagcgcttcgtggagacgctcaaggagctgttcggcgagttcaactacgagatcagggataatcatgagtccctcggcaagagcattctgttccggacctgggaccgcaggatcattcgcttcttcgtcgcgctgggcgctccggttgggaacaagacgaaggtgaagctggagctgccgtggtggatcaagctgaagccctcgctcttcctggccttcatggacggcctctactcgggcgatgggtctgtcccaaggttcgctcgctacgaggagggcatcaagttcaacgggaccttcgagattgctcagctgacggacgatgtggagaagaagctccccttcttcgaggagatcgcttggtacctctccttcttcggcattaaggccaaggttagggtggacaagacaggggataagtacaaggttcggctgatcttctcacagtccattgacaacgtgctcaatttcctggagttcatcccgattagcctctcgcccgctaagagggagaagttcctgcgggaggtcgagtcctacctcgctgctgttccagagtcgtctctggctggcaggatcgaggagctcagggagcacttcaaccggatcaagaagggcgagcggcgcagcttcattgagacctgggaggtggtcaatgtgacctacaatgttactacggagacaggcaatctgctcgctaatgggctcttcgttaagaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2949 - DNA, 2394 bp, Artificial Sequence
  Synthetic Construct, AT-106 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctatcctccctgatgagtggctgcctatcgtggagaatgagaaggttcggttcgttaagatcggggatttcattgatcgggagatcgaggagaacgccgagcgcgttaagagggacggcgagaccgagatcctggaggtgaaggatctcaaggccctgtccttcaatcgcgagacgaagaagagcgagctcaagaaggtcaaggcgctgatccgccacaggtactccggcaaggtgtacagcattaagctcaagtcggggcgcaggatcaagattacctcaggccattccctgttcagcgtcaagaacggcaagctcgttaaggtgcggggggacgagctcaagccaggcgatctggtggtcgttccaggccgcctcaagctgcctgagtcgaagcaggtgctcaacctggtcgagctcctgctcaagctgccagaggaggagacgtctaacatcgtcatgatgattcctgttaaggggcgcaagaatttcttcaagggcatgctcaagacactgtactggatcttcggcgagggggagaggccaaggactgctggcaggtacctcaagcacctggagaggctcggctacgtgaagctcaagaggaggggctgcgaggttctcgactgggagtccctgaagaggtaccggaagctgtacgagacactcatcaagaacctgaagtacaacggcaatagccgcgcttacatggtggagttcaattctctcagggacgtggtctcactgatgccgatcgaggagctcaaggagtggatcattggcgagccgagggggccaaagatcggcactttcattgatgtcgacgattcgttcgcgaagctgctcgggtactacatctccagcggcgacgtggagaaggatagggtcaagttccactccaaggaccagaacgtgctggaggatatcgccaagctcgcggagaagctgttcgggaaggtgaggaggggcagggggtacattgaggtcagcggcaagatctcgcatgctattttcagggtcctcgctgaggggaagcggatcccggagttcattttcaccagccccatggacatcaaggtggcgttcctgaagggcctcaacgggaatgctgaggagctgaccttctcgacgaagtctgagctgctcgtcaaccagctcatcctgctcctcaactccattggggtgtcagatatcaagattgagcatgagaagggcgtctacagggtttacatcaacaagaaggagtcgtctaatggcgacatcgttctggattcagtggagtccattgaggttgagaagtacgagggctacgtgtacgacctctctgtggaggataatgagaatttcctcgtgggcttcgggctgctctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2950 - DNA, 1530 bp, Artificial Sequence
  Synthetic Construct, AT-107 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgtccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2951 - DNA, 2244 bp, Artificial Sequence
  Synthetic Construct, AT-108 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccccagacacgctggtttcgctctcggacgggcggattattgagatcagggaggcggtggagaactcggaggagtcgctgctcgggatcaacggcctgaagccgaaggaggccaaggcgctcaagttctgggagatcgactgggatgggccgatcaaggtcatcaagctgaagaatggccacgagatcaaggctaccccagaccatgggctcctggttatgagggatgggaagatcggctgggtgtcggctaagaacattcgggagggcgactacgtcgccttcatctacaatctcgggcaccgcggcgggaagaagtacacgctcccccagctcctgaaggagctgggcatctccgagtacgagaactccagctcgcaggagctcaacaatcgcgagcaggagatggactccaagcagatcagcattgagctggatgagaggttctggtacatcttcggcgtgattctcggcaaggggaccctgaagggggacaaggtggtcatcttccagaaggatgtcaagccggttattgaggaggcgctgcccttcgtccggatcttcgagtcggctgaccacatcggcttctctcatctcattctggctgaggtcttccgcaggctcggcgttggggagggcaagctccactccctggtgttcggcctgagggaggagtacatcaacgctatgattgccgggtacttcgacgctagcggcaccttcctcaggagggctgtcctgacgagcaagcgcggcgatatcctcaggatgctgtcggtgtacctctaccagatcggcattgtcaacaatctgaggagggacgagcatgctggcgtgtgggagctcatcatttctgatctggagaagttccgcgagaagatctacccttacctcaggattaagaagtcacagttcgacaaggtctactctatttcaaagaacgagggcgatttcctcccggttgcgtctatcttccggaagctgaagttccgcgacggcttcaagaatcggatcctcgacgaggagattccacgcgatgaggtggcgaaggtcctggagtacgctgaggactcacctgagaaggagttcctcaactccctggttgaggccagggtgacatgggttcgggtggagaagatcgaggagaggcattacactggcaagctctacgacttcacaactactacagagaacttcatttccaatggcatcgtctcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2952 - DNA, 2184 bp, Artificial Sequence
  Synthetic Construct, AT-109 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgcctgggacaagggtcctgactgagcatggctactggctgaagattgaggagatgcctgagaagttcaagctgcagcggctccgcgtctacaacatcgaggagggccacaatgacttcagcaaggtggtcttcgtggctgagagggaggtcggctcggaggagaaggctatccgcattgtcacagagtccgggaaggttatcgagggcagcgaggaccatccagtgctcactcctgagggctacgtgtacctgaggaacgtgaaggagggcgattacatcctggtgtacccgttcgagggggtcccctacgaggagaagaagggcgtcattctcgacgagtccgctttcgagggcgaggatccgcaggttgtgaagttcctgcgcgagaggaacctcatcccactgcagtggaaggaccctaaagtgggcatcctcgctcggattctggggttcgctctcgcgaatggctacatcagcgagaacgataatctcaccttccacggcaaggaggaggtcctgagggaggttcggaaggacctggaggagctgggcatcgaggcgattgtcgctgaggaggataagctcaaggttacgtctagggagttcgctttcctcctggagaagctggggatggcccacgactcaatcccggagtggatcattgagggccccctctggattaagaggaacttcctcgctggcctgttcggggctaatggctcgatcgttgagttcaagggcgacgtgccgctgcccattaccctcacgcattcgcgggagctcctgaacgatgtctctcgcatcctggagggcttcaaggtgagggccaagattaagatggggaagaatggctcataccagctcgtcatcgaggacgaggattccattcgcaacttcctggggaggatcaattacgagtacgacccagagaagaaggccaggggcctcattgcttacgcctacctgaagttcaaggagctcatgaaggggaacctgatgaccttcgaggagttcgcccgggacaggggctacgagggcgggttcgtggcggagaaggtcatcgaggttaagagcgtgaagccggagtacgataagttctacgatattggggtctaccactcagctcataatttcattgctaatggcatcgtcgttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2953 - DNA, 2142 bp, Artificial Sequence
  Synthetic Construct, AT-110 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggacacactggtgctgacaaaggagttcgggctcatcaagatcaaggagctctacgagaagctggacggcaaggggcgcaagattgtggagggcaacgaggagtggaccgagctggagaagccaatcacggtctacggctacaaggacgggaagatcgttgagattaaggccacccacgtttacaagggcgtgtccagcgggatggtcgagatcaggacccggacgggccggaagatcaaggtgacgccgattcaccgcctgttcacaggcagggtcactaaggacgggctgatcctcaaggaggtcatggctatgcatgttaagcccggcgataggatcgccgtggtcaagaagattgacggcggggagtacatcaagctcgattcgtctaacgtgggcgagatcaaggtcccggagattctcaatgaggagctggcggagttcctcggctacctgatggctaacggcacactgaagtcggggatcattgagatctactgcgacgatgagtctctcctggagagggtgaactccctgtccctcaagctgttcggcgtcggcgggcggattgtccagaaggttgacgggaaggcgctcgtgatccagagcaagccactggtcgacgttctcaggaggctgggcgtccctgaggataagaaggttgagaactggaaggtgccgcgggagctcctgctcagcccatcgaacgttgtgcgcgccttcgttaatgcgtacattaagggcaaggaggaggtcgagatcaccctcgcttccgaggagggggcttacgagctcagctacctgttcgctaagctgggcatctacgtgacaatttctaagtcaggggagtactacaaggtgcgcgtctcgcggaggggcaacctcgacactatcccagttgaagtgaatgggatgccaaaggtgctgccttacgaggatttcaggaagttcgccaagtccatcggcctggaggaggtcgcggagaatcacctgcagcatatcattttcgacgaggtcatcgatgtcaggtacattccggagccccaggaggtgtacgatgttactacagagactcataatttcgtggggggcaacatgccaactctgctccacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2954 - DNA, 2136 bp, Artificial Sequence
  Synthetic Construct, AT-111 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccgctgacacaaggctcgctacacagcatgggctggtccctatcgggtggctgcaggctaatgggggggctctggactgcacggtggacaggagggctctgggcgaggataggagggggacagttactcgcgccgctgtgccagcgttcctcagcgctggccaggctgaggtcttcaaggttaccacggccgagggctaccagatcaaggccacagcgtggcacgagttctacactgctaggggcaagctcaagctgtcggagctcaaggctggggacgagctgtgggtccagtccggcaaggggcagttcggcgctcagggcagcggggctctcggcctcctgatcgggctgattaccggcgacgggcatttcacgaaccgcggcaaggatgagcaggctgccgttatctccctgtggggcgaggagaggcagctcgctgacgatatcgccggctctgtcaatgccctcattgctgggacctcactggctccgcgcgactacctcgtgaagccagttgctgtggccgagcggaacatggtcttcattcgctcaaccatgctcgtcagggttctggatggctacgggttcaatggcgagacgaagctggaggtgccagaggtggtctggaggggctccgaggcttgcatgaggggctacctccaggggctgttccagacagacggcactgtgaacgtctccagcaattcccagagctgctcggtgcggctgtcgtcttcacaccgccctctcctgcaggatgttcaggtgctcctggcgaacttcggcgtcttctcgcgcatccatgagaggagggaggctggcccaaggtctctcccagacgggcagggcgggcagagggattacctgtgccagacacagcacgagctcatcgtggacggcgagtctcgcgaggcgttcatgagggagattgggttcctcctgcccgctaagcgggagaagtacgacgcttgggtcgccgataaggcgctcgttaagacccagaggttcgcggctaccatcacggcgattgagccagctggcgtggagcctgtctacgatactactcagccagacggcaacacagtcatcttcaatgggctcgttacggggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2955 - DNA, 2382 bp, Artificial Sequence
  Synthetic Construct, AT-112 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctctgcggatcatgaggttctcacatctacagggtggaaggctctccccgctattaaggatgcggatcaggttatgacgctggacctccagacgggcacacagcagtggaactcggtgcaggctaccacgaggttcgcgcgggagggctcactctacaggctgaagtccgacgatatggatgcggtctgcaacgagtctcaccgctggtacctcaatactaaggaccagccaacaacttacaccgctttcaccacgcagcagatgctggataaccagctcgtggctctgcgcaactcctccggcaaggctacggaccagtggaaccacgagtccgggacaactacccacacgaaccataatatccctacagtcggccataacgggaatgttatgttcagctggccagactgcccatggctcccacgcgagttcgtcgctgatgaggcgtgcaacctcgactggtgcaggttcatcggcctcgtgatgggcgacgggtcgattgatcatgtcacggacgctcagggccaggagcactacagcatccagattcatcagagggctgggaacccagcttcgaacgctaatacagaggatgtcctggagaggctggctgctaagctgccaaatttcgtggtccacccatcctgcgttagcggcgcggaggagaagcatacttggaccatcaaccaccgggacatgtaccatttcttcctccccatgatgcgcggcccacagtcctacgaccctctggataacgccatgtgcaggacctaccaggctccagattaccaggccctctcgcggtctgacaatgagcctatcattccagtgccagctgactggaagaccggcaactggtggcacctgcgcaggtggatcaattacccatggctcttctcgctggcccagtctcaggcgagggctatgattaagggcatggctgccgcgaacggggattggtcactctccctgaaggctaggctggacaccggcgattctggggttgtgagggttttcagcaattcgatccccctcatgcacgacatgtcagtgctgggcctcctggccgatactcgcgtgaacattggcgtcgaccataagaaggggcagatgcagctccaggtccctgttaccatgccggcgctcctggcttggtgcatctctttctcattcgcgaactccgacctggctgtggctgctccaaagcctgaggcgtacgataatccgaggcacgacggcttcgtttactgcctcacggtgcccaacgggaatttcctggcccggcgcacagtcgagtacagcgataatgataagattcaggaggtcattgatgctgctcagaagcctttcttcacaggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2956 - DNA, 2154 bp, Artificial Sequence
  Synthetic Construct, AT-113 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttactgcggatacatgggttatgactacggcggggccggctcaggtttcggagctgacggggcggtctttctcggctgtcgttgacggcaaggcctacgcggtgacatccgatgggttcttcaggactggccacaagccagtcctcgctctgaggaccagggagggccctgctctccgcctgacggctgaccatagggttcgcagggtggctaggaggaccaggtacacgctggaggctgagtggaccgaggctgggcagctgcagccaggcgacgagatcctcctgcacgatcatagggctctcggcgggtgggagggggctggcacacacgctgaggggtacctcctgggcctcctgatcggggacggcactctcaagtccgataaggctgtcattagcgtttgggctccagagctgaaggtggctggcgggggcgctgtcgcctacgcgcagaccggcgccgggggcatcgttcaggccgcggaggctgctgctgctacgctctcccacagggtcgacttccggggcttccagaggtcgatttctgggaggggcgaggctaggatggcttctggcgccgtgcggcacctggctcatgagatggggatgaggccaggccataagacaatcaccacggccatggagaaggcgtccagcgtcttcactgaggggctcctgaggggcctcttcgacgctgatgggagcgttcagggctcgcaggagaagggcgtgagcctcaggctgtcacagtccgatctctcgctcctgcagaccgctcagaggatgctcctgaggctgggcatcgcctccacgatctacccgaacaggcggctcgctcaggctaggccactgccagacggcagggggggcctgcgcgtctacgagacagcgtcacagcacgagctcgttatctccgctgataatctgaggatctacgccgagcggattgggttcgccgacacggataaggctgacaggctcgatcaggctctgggctcttacaaccggtcactcaatcgggagcgcttcacagtgactgtcgagtcgctgaccgaggagggctctgaggacgtgttcgatgttactgtggcggatattcatgctttcgatgctaacgggctctacgttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2957 - DNA, 2112 bp, Artificial Sequence
  Synthetic Construct, AT-114 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgcgggggttctctcgtcaaagattaagattcctgggggctggaagactatgggcaatattcgggtcggggatgaggtcgttacgccagacggcgggacagctaaggtcctcgctgttcacccacagggcgtgactaaggtggtcagggtccatttcaaggacggccggtacacagacgtctcgcccgatcacctctggaaggttcgcaggcaccattggtgcaacgataaggccatggcgaagctgactcgcgaggaggtggaggagagggtgtggagggtcatcaccacgaacgagctcaaggactacattggcctgagcacgaaggtttacgtgcagctcatcgagccggagaggaatgcggataagccattcaagattcacccttacgttctgggcgtgctcctgggcgacgggtgcatctcccagaaggctgtcgatattaccaagccataccagcagctcttcgacaaggtgcagagcctcctgcctgagcacctggagtgcgtctggaggccaaacaggaagggcgacggggagcccaagaccttcggcatccgcttcaaggatcggcgctccgagcagcacatcaattggcatattcgggacggcctgaaggagctcggcctgtacgggatgcgctcttggggcaaggtcatccccgaggagtacctccacgggtcagctaagcagaggctggagctcctgcagggcctcctggacaccgatgggacggttgataagcataagtcagtgtccttctccagctcgtctaagctcctgagcctcggcgtccagtacctcgttaggtcgctgggcgggatggctaggctgcaggagcgcacaccacactacactcataatggcgagaagagggaggggcggaccgactaccgggtctacatccgctacccgaggcccgaggagctcttcacgctggatcacaagagggagcgggcggtgtcccaccagcatacagagactctccgcctgcaggtcacccatatcgaggagaggcctgacgaggagacgcagtgcattactattgatcatccagatcatctctacattacggacgacttcatcgttactcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2958 - DNA, 2361 bp, Artificial Sequence
  Synthetic Construct, AT-115 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggggacaaaggttctcatggctaacggggatgacaagaatattgaggacatcgcggtcggggaggaggttctcgggaaggacggcctcccacgcgaggtggtcgctctgcctcgggggagggagacaatgtacgaggtcagcgagaagactcagcacagggcggagaccgttttcggcacggcctcgtacacatgcaacgcgactcacaagctcgtgctgcagaccaatcagagggttaacatcacgaatcatgtgctccggggcgagtctcagacctcagttacgtacttccagatgaagaccgctgtggctgacgggagggagattgagctcccaaagctgtgcacgaagtccttccagcactccagccatggccgggagaacgcttggaagaaggccgaggtcttcgcgtccacaatcagccgcgaccccattgattggactgcggaggctcgcgacatctctaggctcggctaccacgtgcgcagggctaccaggcagctctggagcccagttctggtggagaaggaggtcctggctcctatgatcgccaagcggggcttcgatgagtccattgcgccgtacatggcttacctcgtggggctgtgggtcggcgacgggtactccgatagggccacattcagcatcgacattcaggatgtggagatccacgagaggattaaggacttcgcctcacatgctggcctgactccaaggatcgcttgctacaagaagtccagggatgctaccatttcactccacaactccgagacgcggggcaagaatgtccgccagaacctgaatacggggaacctcctgtggtcgctcctggctgagatctgcggcaagaaggagaatgagatgctcttcaagctggtgccaagcttcctccgctcagagtccatcgcggtccgggagtacttcatttctggcctggtcgactcagatgggcacgttaagcgcgacgaggctgataagtgctacagcgccacagtgaagactatctaccctgccgtccgggacggcctcgtcagcgttgcgcgctcgctggggattcagacaagcgtgtcggtcgaggaggccaaggaggtcaactcggttaagcatcaggagtcttacgccatctacatggccaactcctccgctctcgactcggtgctgtctaagtgcgctgctccaaggaagcgggctgaggagcccgtttgcgtgaacagggagccgcacccctacacgttccacatggtcgagaaggaggaggacgatttctacggcatcactctctcagaggactcggatcatcagttcctgctctctaatctcgctctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2959 - DNA, 2298 bp, Artificial Sequence
  Synthetic Construct, AT-116 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgggggacactctcattacactggctgacgggcggcgggttcctattcgggagctggtctcgcagcagaatttctcggtctgggcgctgaacccgcagacgtacaggctggagagggctcgggtctcccgggccttctgcacaggcatcaagcccgtttacaggctgaccacgaggctcgggaggagcattagggctactgctaatcaccgcttcctgaccccacagggctggaagagggtggacgagctccagcctggggattacctggctctcccaaggaggatccccacggccagcacaccaactctgaccgaggctgagctcgctctcctgggccacctgatcggcgacgggtgcactctccctcaccatgtgattcagtacacctctagggacgctgatctggctacgctcgtcgctcatctggccacaaaggtcttcggctcaaaggttaccccgcagatccgcaaggagctcaggtggtaccaggtgtacctgagggctgctaggccactcgctcctggcaagcgcaacccgatcagcgactggctgagggatctcggcattttcgggctgcggtcgtacgagaagaaggtccccgcgctcctgttctgccagacgtccgaggccatcgcgacattcctgaggcacctctgggctactgacggctgcattcagatgaggagggggaagaagccatacccagctgtgtactacgcgacctccagctaccagctcgcgagggatgtccagtcgctcctgctccgcctgggcatcaacgccaggctcaagaccgttgctcagggcgagaaggggagggtgcagtaccatgtgaaggtctccggcagggaggacctgctcaggttcgtggagaagattggcgctgtcggggctaggcagagggctgctctggcctcggtttacgactacctctctgtgcggacgggcaacccaaatcgcgatatcattcctgtggctctgtggtacgagctcgtccgcgaggccatgtaccagaggggcatctcgcaccggcagctgcatgcgaacctcgggatggcttacggcgggatgacactgttccggcagaatctctctcgggctcgcgccctgaggctcgctgaggctgctgcctgcccagagctgaggcagctcgctcagtcagacgtctactgggatccgatcgtttccattgagcccgacggcgttgaggaggtgttcgatctcactgttccagggccacataacttcgttgctaatgacatcattgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2960 - DNA, 2130 bp, Artificial Sequence
  Synthetic Construct, AT-117 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacggcggagacatgggttatgacggatgagggggctaggcaggtctcggctctgctggatcggcctttcagggcggtcgtgaacggcatcgcctacgattcaggcgagcacgggttcttctgcaccggcctcaagccagtgaagaggctgtccaccgcttgcgggaggcacctcaggctgacggctgaccatctggtccggaaggtggtcggcaagacgaggtggaggcaggaggttgagtgggtgccagctggcgacctcaggcctggggatgaggtgaagctgcacgaccatcgcaccgcgatgattcagacgaggcctgaggatgagaggggctacctcctggggctcctgatcggcgacggggttattcgcgacgataagacactcatctccgtgtggccacaggaggagtgcattggcgctcagccactggggcaccccgtcatgcataaggttgaggctctcctgagggacctcccacacagggctgatttcgctggctggcagaaggtcgagggcaggggggagtacaggatcggcacagctgctctcactgctctggctgctgagtacggcctcacacgcgggaggaagaccatcacgccggagattgagggcgctgagactgctggcttcggggctgctgtcctcaggggcctgttcgacgctgatggcagcgttcagggggctcaggagaagggcgtgtccgtcaggctcgctcagagcgacctggctctcctgcaggctgctcagaggatgctcgctaggctgggcatgaacgctgtgatctacgagaatcgcagggaggcgggcagggctttcctgccagacgggaagggcgggcaggctcacttcgagaccaaggcgcagcatgagctcgtcatctcgggcgagaacctggcgacataccaggagcggattgggttcactgatgtggctaaggctaggaggctcgctgtcgctctgtcgggctacaagagggccctcaatcgggagcgcttctctgccgttgtggcggacgtcgttgacgatggcatggcggaggtgttcgatgttcaggttccaggggttaatgctttcgatgctaatggcttctacgttcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2961 - DNA, 2058 bp, Artificial Sequence
  Synthetic Construct, AT-118 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcaagcgggggacagaggtcattatgttcgatgggacaactaagaaggtggaggacgttatcgtgggggacgttctcatggggccagacagcacccctaggaacgtgctctcgctgggcagggggagggagatgatgtacgaggtgaagccacggaagggcgagtcctacacggtcaatgagtcacacatcctctccctgcgcaccacgacaggcattgcgaaggggtcctggcctgacaacacagtcttcgatatcagcgttcgggactggctcaagctgccaaagtatgtgactggccctaatgggtacctcaagggctggagggtgccagtcgatttcccaaggaaggagcaggacgaggctctcctgccaccatacctgatgggcctctggctgggcgacgggacttccagctcgggcgctatcacctcgggggagaatgagaaggagattagggcttacctggagtcttacgctgctaggaacggcatgcagatcaggaaggaggggctgacttggtctatttcacacggcaacaccgggcacaagaagcatggcttcacgcatgcgctcaagagcgctggggtgctgaacaataagcacatcccgcataactacaagtgcggcgataggaggcagaggctggagctcctggctggcctcctggactctgatgggtactgcgatctctcaaaggctggcttcgactggatttccgttagcgagaggctggccgacgatttctgctacctctgccggtcgctgggcttcgctgcctacaagaagaagacctgcaagcgctgcgcgaacacagacgtctggggcgattacttcagggtttcggtgtctggggacttctccgaggtgccattcgtcaggggcaggcatcagaatctccccaagcgcaacatcaataagaacgttctgaacgtgggcatcgagtccattacccccgtcggcgttgacgattacttcgggttcacaattgatggggattcaaggttcctcctcggggatttcacagttactcataataccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2962 - DNA, 2028 bp, Artificial Sequence
  Synthetic Construct, AT-119 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctcagccgctggattcgctcgttctcgcgcctacggggttccgccgcatgggggatctcagggagggggatgaggtcgtggtccctaacggcgagatcgcgctgattgacggggtcttcccacagggcgtcagggacgtttggcggatcgtgctgagcgatggctccagcgtcgagtgcgacgatgagcacctctggattgtcggcacatcgtgcgggtggcataggggccagactccgaaggtcatgaccacgcgcgagatcaggctcgacacattcaaggccaacggctcctccaagtggtatgtgccagctgctaccccagtcgacctggggccagatgttggcctgccactcgacccttacctcttcggcctcctgctcggcgatgggtccttccgccacaatctgaggctcagcaccgtcgacgatgagatcagggacgctgctgctgatgctgtggctccggactgccggctggtgcccgtcaccggctcgcgctgcgattacacgatccagctcaagcagcggtctggcggggttcgcaacccagtgattcaggctctgaggaggctggacctctgggggaagacctcccacggcaagttcatccctgaggatttcaagaacacgtctattaagaataggctgtcactgctccaggggctgctcgacacagatggcactgttcatgccgacgggatgtcagtgtccctcaggagcgcttcgctgaggctcgctgaggacgtcgcttggctggttcgctctctcggcgggagggctcgggtcctcccagagaaggctgccttccatgtttcagtggctctgccagacgagtacgctcctttccggctctcccgcaaggctgatcgcgtgaggccaaggcccaagtacaatacgttccggaggggcatccgcgctgtggagtatgtgggcaggaagccggctcagtgcatttctgttgggcatccttcacatgcttacgttacggataatttcactgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2963 - DNA, 2511 bp, Artificial Sequence
  Synthetic Construct, AT-120 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggggacacaggttatgatggcggacgggtcggacaagtcgattgaggatattcagctcggggagaatgttatgggcaaggacggcacaccaaggactgtgatctccctcccccgcgggaaggagacaatgtacgaggtctgccactccagcaccaagggcaccacgaaggacacgctgatgaactacgtgtgcagcgggaatcataagatcgtcatgcagacaccacagcagatcggcattactgagcacggcattgacgggaagacctacacgagcgtctcgtacttcgctctcagggattcgcagcacggctaccctatcgttaagaagctgacgaagtctttcgagcatcagcagcacggcgggaaggagcagaccctcatcacggttaacaatttcgtgtcgtctctgaagtcggagccgattaactgggacgtggaggccaagcattacgagtccctcggccactacgtcaagaagtgcagctaccagctgatcaacccggttttccatcagagcggcaagctcgcccaggagattgcgtcgctgaattactctaaggacaaggctcccctcctggcctggctcatcggcttctgggtgggcaacggggctatgcgccactctcagttcgtggtcgagtcacaggacattgagctcgtcaacaggatccaggatattgcgggcctcctgaatctgtccgcgacaactgcttgctactactctggctcaaaggacgatgaggccaagctcgcgaagctgaactcatccagcgctgagggcttcgaggacgacctggaggggaatccaagcgtgaaggagctcgcggacatggataggctgtccgagagcaagacagcgactctgcctaccgctttcggcgtcgagaacatcgacgagctcatcatttcactgggcgaggggaggggcaacgggaatgtcttcgcccaggttatcggctctttcgggattgacctcgctgacaaggatacactggttactaagatcgcccatgagctcgctggcgacgccttcgaggtgagggagcagttcgtggctggcctggtcgatgctgctggctacgtgcgcaaggacgtgtacgatcacgcgtcagaggctaccatctccacggagtcgaagtctaccgtcctcggcctggttaagattgccaggtccctggggatcaagattaccgtgacgtcagacgattccgacgatagcgacgagcacgatcatgcgcactgcggccatgaccacgggtcgtcttcatcctacacagccgtcatgactggggatgcgctcacgaacagcatgcggttctgcgcgatcggccgcaatagggttgctgccaaggagttcatgcgccaggctgtgcccttctacttcagcctggagaagaagtcggaggacgattactacggcatcacagttccagataatacggataagcagtacctgctctcttctatggctctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2964 - DNA, 2454 bp, Artificial Sequence
  Synthetic Construct, AT-121 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcagtctcttacgatacgccagtcctcatcagggaccctattaacaagatccatctcgtgaagatcggggagttcattgataagttctacgaggagggcgaggagaggacggctaagcacgtgaatgggtactacgtcctctcccatgacggcttccaggtggtctggaagccgatcaagtatgtgctgcggcaccgcacaaacgagatctacgagatcatctacgagggcgggggcaagctggaggctaccggctcgcattctgttttcgtgctcgacccggatacgctggatatcgtcgagaagcccgttatgctcctgaataagggggagtacctggtttctttcaacggcgtgaaggagaataaggaccaccagacaatcgacctcattgatctggtttcggactacaacgatgtctacgttgataatatcccatctgagctcaagaagcatactgggggcaggaacccaatccctctcaagcagtacatgatcctgaggaagcgggtcattacaaagaagaacaatagcctcatcaagctgcgcaggtcgaagtacactctcccgattcggctcgtgctggacgagaagctcgccttcctgttcggggcctacatcgctaacggctgcgtcaaggagaggagggacaagctgatctgcttcaccttcggcaagtccgccaagaacatcgcggataaggtcatgaatattatgtacgagaagttcaacatcaagccattcattgacgatagggggacatacatcatctacgagtaccctcacactctcctggcgatcattttcgagaagctcctgggccgcaagctggaggagaagaagatgccagagatcctgtggtccagccctaagagcgtgattcgcgcgttcttcgagggcctcagggcttactcccagcgcaccctgaggaggaggtacacgagctacaccacggctaacaagaatctcgcctaccagctcctgtggctggctaggttcgctggcttctactcggtcctcaaggaggagaaggaggccgggaagaacaatggcaagacgtactaccatgtgatcgtctacctggaccagtcttacaggaagccgaacgcgtcagagcgggttccggtgaagcccatcctcaagctgattaagtacacaaagccaaggactatgccaccagagctcgcttacatcaagaggcgggagttcatttcaaggaagaccgcgctcaaggctctggagtggatccgcagggacggctcattcacggatttctcccgcgagtacctcaggaagatcgagtccctgattaacggggacatcattgtcctgaagatcaaggatgttcgcaagaagcagtacaagggctacgtgtacgacatttcagttccaattacggaggctttcttcgggggcaacattccaatcctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2965 - DNA, 2064 bp, Artificial Sequence
  Synthetic Construct, AT-122 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcataccataaggatttcaagattatgctcgctgacgggcgcaaggttcgcatcggggatctcgtggatgagctgatcggcaagaatagggagaaggttatcaagggcaaggacacagagattctgttcgtggacgatctcttcctcctgtcgtacaatatgcggtctggggagcaggttctggtgaaggctgatcgggtgagccgccacaaggctccagaccagttcatcaagctgcgcttctcgaacggcgctgagatcattgtcaccccggagcatcccgttctcatcattaacaatggcaagatcaagaccgttagggcggatacggtgcggaaggggaccctgacgatcggcgtgctcgggcacaagatcattaaggaggtcaacgaggacgatatcattaacaatatccgcaggaagattgtgctggacaaggagctcccgtacatccacgctaagaatatttcagaggccgtcgagatgcgggaccagctgatgtccatcgatattcccaccttcatcgttaagcataagaacgagattcgcctgtacccatccggcccttgcagcctcaggaggctcctgctcatgcacggggtcgaggaggtggtcttctcggacgagctgctctacgagatcatgaattgccatctctacccggccacctggtacgagctgctctactccatgggcctgacgaagatcgccaaggagctcaacgtgtacgacttcgagattctggcgggcatcattaagaaggtggagaaggaggtcatcatgctctctcaggtcctggggctccgcaacgagacacagactgagctgctccatctgaagtcaaggcgggagctgctcatcaggctcaaggacaagctggatatgctccgcaagaggctgaaggacctggaggaggccctcggcaaggatgccgtgatcaggatgattacagacgtcgaggttatcaagaacactgactccgattgggtctacgacattactattgagccttaccacctcttcgtttcggatgggctcattctgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2966 - DNA, 2046 bp, Artificial Sequence
  Synthetic Construct, AT-123 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgggaaggggacaccggttatgatgtacgatgggcggacaaagccagtggagaaggtggaggtcggggacaggctcatgggggacgatggcagcccaaggacggtgcagtcgctggccagggggagggagcagatgtactgggtccgccagaagaggggcatggactacagggttaacgagagccacatcctctcgctgaagaagtctaggagggagggcgcccgcgacagggggtcaatcgcggatatttccgtccgcgactacctggatcagtctgacaagtggaaggacgataacaagggcttcaaggtggctgctgagttcccagaccagccagtccccctcgatccttacttcctcggcctgtggctcggcgatgggaagtccgacaatgctaggatctacaccacggacgaggaggtcatcacgggcctgcaggagattgccgagaagcggggggacacaatttcagtgtccgatgagcatcggcgctgcccagcctacctcgtcaagtctggcgacaggggcggggctatggctaccagggagtcagttcagggcgctctgagggctctcggcgtgctgggggacaagcacatccctcatctgtacctcggcaactccagggggaagcggctcaggctcctggctggcctgattgacagcgatggccacctcaatgacgggcatggcgggacgtacgagatcacacagtccagcgagcagctggcgagggacattaagttcctctgcgatactctgggctaccggacatcgctcactcagaagaccgctcgcatctcgtctaccggctacgagtccgaggttcacagggtgcggttcaacgggaatgttgacgagattccggtgcgggtcgagcgcaagaaggcttccccatggactgatgtcagggactggcggatgaccggcatcgatgtcgagcccgacggcgttggggattacttcggcttcactctggatggcaatgggcgcttcctcctcggggatggcactgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2967 - DNA, 2088 bp, Artificial Sequence
  Synthetic Construct, AT-124 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgatcctgagacagaggtcgtgacagtggacggcattaggcatgtggaggagattgaggtcggggatagggtttactcgctgaacccagacacgggcgctgtcgagatcaagcccgttaccgcgacgcagagccagcattacgctggcccgatggtggagattaagaaccagcataccgacttcctggtcacgcccaatcaccgcttcctcacacagaggttcacttcgggcgagtacacagatctggagtgggagactgctggcgacatgctcggggatcgcatccgcaggaggctcccatcactgaggtccctccctgctacacaggagaggccaggccctatctcactgtccgctgtgtgcgacaggctcgctatcgagcacaagactggcccacgcgggattaaggagctgaggaggcaggctaggtggcagcctgaggagtacgagctcacagattggctgaggatcctcggctggttcgccacagaggggactctgtacaagtctaaggcgaggcagtacgagaacggcaatgtgcggggggtctcataccagaccacgctctgccagaagaacgacatcggccgctccgagattgcgacgctcctgaacaggaccgggatcacgtactccagcgaccagaatgatcatagcttctgctcgaaggttctgtacgagattctggaggctgagtgcggcagcgactcgttctctaagcacctgccaccatggatcttccagctggggccaaaggacctcaagattgtcttcgataccctcatgcagggcgactccgctgctaacggggatcggttcacaacttcgtctaatcagctggccgaggacttcatcaggctcgctatgcacattggcaggagggctttccacatgccgaacgatgggtctcacaggatccaggttaataccgtgaggggccagcggccgacgattaagcccaagcatcggcagcaggtcgactacgatggcatgatccactgcctgaccgtggcggataatcatactgtgctcgctggcaggaataggaagttcaattggactgggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2968 - DNA, 2301 bp, Artificial Sequence
  Synthetic Construct, AT-125 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatttcgggggatagcctcattagcctcgcctcaacgggcaagcgggtttcaatcaaggatctgctggatgagaaggatttcgagatctgggcgattaacgagcagaccatgaagctggagtctgctaaggtttcacgcgtgttctgcaccggcaagaagctggtgtacatcctcaagacgcggctggggcgcaccattaaggctacggccaaccacaggttcctcacgatcgacggctggaagcggctggatgagctgtcactcaaggagcatatcgccctcccaaggaagctggagtccagctcgctgcagctcatgtccgacgaggagctcggcctcctggggcacctgatcggcgatgggtgcaccctgcctaggcatgccatccagtacacgagcaacaagattgagctcgcggagaaggtggtcgagctggcgaaggctgtcttcggcgaccagatcaatccgaggatttcccaggagcggcagtggtaccaggtttacatcccggcgagctaccggctcacacacaacaagaagaatcccatcactaagtggctggagaacctcgacgtcttcggcctgcgcagctacgagaagttcgtgccgaatcaggtcttcgagcagccacagagggctatcgcgattttcctgcgccatctctggtcgacagacgggtgcgttaagctcatcgtggagaagtcttcacgccccgttgcttactacgccacttccagcgagaagctggctaaggacgtgcagtccctcctgctcaagctcggcatcaacgcgcgcctgtcaaagatttcccagaacggcaaggggagggataattaccacgtgacaatcactggccaggccgacctccagatcttcgtcgatcagattggggctgttgacaaggataagcaggcctccgtcgaggagatcaagacacacattgcgcagcatcaggctaacactaatagggacgtgatcccaaagcagatttggaagacatacgtcctgcctcagatccagattaagggcatcaccacgcgcgatctccagatgaggctgggcaacgcttactgcgggacggctctctacaagcacaatctgtcgcgcgagagggctgctaagatcgctaccattacgcagtctccggagatcgagaagctctcgcagtctgacatctactgggatagcatcgtgtcgattacagagactggcgtcgaggaggttttcgatctcactgttccagggccacataacttcgttgctaatgacatcatcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2969 - DNA, 2319 bp, Artificial Sequence
  Synthetic Construct, AT-126 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcgggggatactctcgtcgcgctgacagacgggcggtcggtttctttcgagcagctcgtggaggaggagaagcagggcaagcagaatttctgctacacaatccggcacgacggctcgattggggtggagaagatcattaatgctcgcaagacaaagactaacgccaaggttatcaaggtgacactcgacaacggcgagtctatcatttgcactcccgaccacaagttcatgctgagggatgggagctacaagtgcgccatggatctcacgctggacgattcgctcatgcctctgcatcgcaagatctcgaccacggaggactctggcatcaccattgatgggtacgagatggtgtggtccccgaggtccgacagctggctcttcacgcacctggtcgccgattggtacaaccggtggcagggcatctacattgcggaggagaagcagcattgccaccataaggacttcaataagcgcaacaataacccggataacctcatcaggctgtctcccgagaagcacctcgccctgcaccggaagcatatttcaaagacactccaccgcccagacgtggtcgagaagtgccgcaggatccatcagtcccctgagttccggcgcaagatgtcagcgaggatgcagtccccggagactcgggctatcctcagcaagcaggctcaggcccagtggcagaatgagacctacaagctgacgatgatggagtcgtggaggtctttctacgacagcaacgaggattacaggcagcagaatgctgagcagctcaacagggctcagcaggagtactgggctcaggctgagaacaggaccgctcaggctgagcgcgttaggcagcatttcgctcagaatccgggcctgcgccagcagtactcggagaacgcggtgaagcagtggaataaccccgagctcctgaagtggcggcagaagaagacaaaggagcagtggactccagagttccgcgagaagaggagggaggctctcgctcagacctactacaggaagacgctcgccgcgctgaagcaggtcgagatcgagaacgggtacctggacatttcagcctacgattcctaccgcatcagcaccaaggacaagtccctcctgcggttcgatcgcttctgcgagaggtacttcgagaatgacgagaacctcgcgcgcgaggctgtcctgaattacaaccacaggatcgtcaacattgaggcggtttccgagacgatcgacgtttacgacattgaggttccacatacgcataacttcgctctcgcttcaggggttttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2970 - DNA, 2274 bp, Artificial Sequence
  Synthetic Construct, AT-127 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatttctatggactctatgattctgacaactgagggctacaagtcgctgcaggagattttcgagacacagggggttaaggtggacaacaaggagaaggttatcgagctgaagtacccgctcattaatcggtacggcgacgtggagtacacctcccacttcacgaagaacggggagaagccaacaaagcgcatcaagactaataagggcattgagctggttaacacatacaatcatcctctcctggtgagggaggggttcaacctgatctggaagaagagcgaggacatcgaagtgggcgatattctcgtgtcccgcgtgggcgaccaccagttcgggaacaataacactgtggagaacgaggaggaggcttacgctctgggctgcatggtcgcggattcttacctggggtcatactcccggctcagcttctcgaacgacaagaaggagatcctcgataaggtctcaaagttctggaacaccttctccaataaggaggtttactacgacacctacaaggagtccaaggggatcacgattcacctgcatgacacaaacaagactaaggagttccatgataagtacaagatcgagtacggcgtcgctaaggacaagaagatcccgaagtgcattatggagagccccgagaacatccagctggccttcgtctcgggctacctggagtgcgagtccagcatctctgagaagaacctggaggttacctctgcttcaaaggacctcctgaaggatctccagctgatcctctcgaacatcggcattgtgtctacgaataaggagaaggtggtcaagaagtacaagcacaacaagtactaccggctgatcgtcaatcgcaaggagctcattaagctcctgccgctcctgaggttcgagacgcagcagcggaagaaccagaaggagaatttcctcagcaataacacaaagatcaagtcgtcttacggcaacactattgaggggtcacgctacctcctgaagaagtacagggactccctgaatatcgataagaaggagttctccaagtacctcagccgggacaccatcacgattgatcgcctgagggaggtcatctcgctctacccggacggcgataaggagattcgcgagctgttcgagaacgttgtgaataacaatatctactaccagaaggtggagcaggtcctggagggcgagatcattcccaccttcgacgtttgcatgcctaagactcattccttcatcgccaacacaatcgtcaaccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2971 - DNA, 2094 bp, Artificial Sequence
  Synthetic Construct, AT-128 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccatcctgcggacactaaggtcatcgtgaagggcaagggcatcgttaatatctcggacgtgaaggagggggactacattctcggcatcgacggctggcagcgggtcaagaaggtttggaagtaccactacgagggcaagctcatcaacattaatgggctgaagtgcacgccgaaccataaggttcccgtggtcacagagaatgacaggcagactcgcatcagggattccctcgccaagagcttcctgtcgggcaaggtcaaggggaagatcattaccacgaagctcttcgagaagatcgcggagttcgagaagaacaagccgtcggaggaggagatcctcaagggcgagctgtctgggatcattctggccgagggcaccctcctgaggaaggacatcgagtacttcgattccagccgggggaagaagcgcattagccaccagtaccgggtggagatcacgattggcgagaacgagaaggagctcctggagcggatcctctacattttcgacaagctgttcggcatccgcccatcggtgaagaagaagggggataccaacgcgctcaagatcacaactgctaagaaggccgtctacctgcagatcgaggagctcctgaagaatattgagtcactctacgcccctgcggttctgcgcggcttcttcgagagggacgctaccgtgaacaagatccgctctacgattgttgtgacccagggcacgaacaataagtggaagatcgacattgtcgcgaagctcctggattccctcggcatcccatacagccgctacgagtacaagtacattgagaatgggaaggagctcacaaagcatatcctggagattactggcagggatgggctcatcctgttccagacactcgtcggcttcatttcgtctgagaagaacgaggcgctggagaaggctatcgaggttagggagatgaaccggctcaagaacaattctttctacaatctgtcaaccttcgaggtgtcatccgagtactacaagggcgaggtctacgatctcactctggagggcaatccttactacttcgccaatggcatcctcacacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2972 - DNA, 2628 bp, Artificial Sequence
  Synthetic Construct, AT-129 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctatcctgcctaacgagtggctgcccatcatcgagaacggggaggtgaagttcgtgaagatcggggagttcattgatcgctacatggaggagcagaaggacaaggtgcgcacagtcgataacactgaggttctggaggtggacaatatcttcgccttctccctgaacaaggagtctaagaagtcagagatcaagaaggtgaaggccctcattcgccacaagtacaagggcgaggcgtacgaggtcgagctcaactccggccgcaagatccacattacaagggggcattctctcttcactatcaggaacggcaagatcaaggagatttggggcgaggaggttaaggtcggggacctcatcattgttccgaagaaggtgaagctgaatgagaaggaggctgtgatcaacattccagagctgatctctaagctccctgacgaggatacagccgacgtggtcatgaccacgcccgtcaagggcaggaagaatttcttcaaggggatgctccggaccctgaagtggatcttcggcgaggagtcaaagcggattcgcacgttcaacaggtacctcttccatctggaggagctcggcttcgtgaagctcctgccgaggggctacgaggtcaccgactgggagggcctgaagaggtaccggcagctgtacgagaagctcgtgaagaatctgcgctacaacggcaataagcgggagtacctggttcgcttcaacgacatcaaggattcagtgtcctgcttcccccgcaaggagctggaggagtggaagatcggcacaaggaaggggttccgcaggaagtgcattctcaaggttgacgaggatttcggcaagttcctggggtactacgtctcggagggctacgctggggctcagaagaacaagactggcgggatgagctactcggtcaagctctacaacgagaatccaaacgttctgaaggacatgaagaatatcgcggagaagttcttcggcaaggtccgggttgggaagaactgcgtggatattcctaagaagatggcttacctcctggctaagagcctgtgcggcgtcaccgctgagaacaagaggatcccgtcgatcattttcgactccagcgagcccgtgaggtgggcgttcctcagggcttacttcgtcggcgacggggatattcacccatccaagcgcctcaggctgtccacgaagagcgagctcctggccaatcagctcgtcttcctcctgaactcactgggcgtttcgtctatcaagattggcttcgactccggggtctaccgggtttacatcaacgaggatctgcctttcctccagacctcccgccagaagaatacgtactacccgaacctcatccccaaggaggtgctggaggagattttcggccgcaagttccagaagaacatcacgttcgagaagttcaaggagctcgcggacagcgggaagctggataagaggaaggtgaagctcctggacttcctcctgaatggcgacatcgtcctcgatcgggtgaagaacgtcgagaagcgcgagtacgagggctacgtgtacgatctctcagtggaggataatgagaatttcctcgtgggcttcggcctgctctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2973 - DNA, 6972 bp, Artificial Sequence
  Synthetic Construct, AT-130 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgcggcctacgatactctcgtgctgcagaaggacgggtcgctggttacgctggcggaggtttacaagcggcaggagattgagctgctcacactgggcaagaacagcaagttctacctcactaagccatcggccttcattgacgatggcatcaagcctattttccgcgtcaccacgaagctcgggaggttcgtggagacaactatcacccacccgttcctgaccgtgaacggctggaagcccctcagcaagctgcaggtcggggagaagattgccgtgccccgcaggctcaacattttcgggaatgagaccatctcggagtctaagttctccagcctgatcaacttcgacaatctctacctgttcccgctcgtgttccagctggagcggtcgcagctcgcgctgttcattcgctacctcttcagcctggatggctgggtgaagatctaccagaacaagatcgtctgcttcgggtactcaaccgtgtccgagaagctgatcaggcagattcagcacatcctcctgcggttcggcattgtctccgggatcgagaagttcgaggagaagcggacggagaagatcaaggtggtcaaggaggtgaagagccagcggtcgcaccgcgaggagttcacattcgctacttaccgcaactgctactgcgacggcaagtggcacctcaccattacggatgccctctcccagaagaacctgatggaggacatcggcgggttcgatagcaagaacttctacctgttcgacctcctgcagccgcacaacagcggcaatcaggagctggagaaccatctgatcttctgggatgagctcgttaatgtgctggcgaagttcgccgcgtctaagaaccagtcactcaagaatcgcaccgctaaggggaagtcccccaagaacagcgagaatctgaccacgacagagacgatttgcaggaagaacatcctcgccaacatggagaatctgccgagcgacaaccagaatttcgattcggagaagctcgacctgtctcagccccacaactcagggaaccaggagctggagaatcatctgatcttctgggacgagctcgtcaatgttctggccaagttcgcgacctcgaagaaccagtctctcaagaataggactaccaagcggaactcaccgaagaactccgagaatctgacgacaactgagaccatctgcaggaagaacattctggcgaacatggagaatctgccctctgataaccagaatttcgactcagagaagctcgatctgccgcagccccacaactccgggaatcaagaactggagaatcatctgatcttctgggacgaactcgtgaatgtcctggctaagttcgctgccagcaagaaccagtcgctcaagaatcgcaccacgaagaggaactctccaaagaactcagagaatctgacaactaccgagaccatttgccggaagaacattctggctaatatggagaatctgccttctgacaatcagaatttcgatagcgagaagctcgacctgccacagcctcataattccgggaatcaagagctggagaatcatctgatcttctgggacgaattagttaacgtgctggctaagttcgccacatccaagaaccagagcctcaagaaccggacgacaaagcgcaactcgccgaagaactctgagaatctgactaccacggagactatttgccgcaagaacattctggctaacatggagaatctgccatcggacaatcagaatttcgactctgagaagctcgatctgtcccagcctcacaacagcggcactcaggaactggagaaccatctgatcttctgggacgaactagtcaacgtcctcgccaagttcgcggcttcaaagaaccagtccctcaagaatcggacagcgaaggggaagagcccgaagaactcggagaatctgaccaccaccgagaccatctgccgcaagaacatcctcgcgaacatggaaaatctgccgtcagataatcagaatttcgattccgagaagctcgacctgtcgcagccccacaactctgggaatcaggaactggagaatcatctgatcttctgggacgaactggtgaacgtcctggcgaagttcgctacctctaagaaccagtccctgaagaataggacgacaaagcggaactccccgaagaacagcgaaaatctgaccactacggagaccatttgcaggaagaacattctcgcgaatatggagaatctgcccagcgataatcagaacttcgactcggagaagctggatctgcctcagccccacaactctggcaaccaagaactggagaaccatctgatcttctgggacgaacttgttaacgtgctggccaagttcgcgacatcgaagaaccaatccctgaaaaatcgcacaactaagaggaactcaccaaagaactccgaaaatctgactaccacagagactatttgccggaagaacatcctggccaatatggagaatctgccgtctgacaaccagaacttcgactccgagaagctggacctgccacagcctcacaacagcgggaatcaggagctggagaatcatctgatcttctgggacgaactagtaaacgttctggctaagttcgccactagcaagaaccaatccctcaagaatcggactaccaagcgcaactctccgaagaactcagaaaatctgaccaccactgagactatctgcaggaagaacatcctggcgaatatggaaaatctgccctccgataatcagaatttcgactccgagaagctcgatctgcctcagccgcataactctgggaatcaggagctggagaaccatctgatcttctgggacgaactagtgaatgtgctcgccaagttcgctacctccaagaaccaatccttaaagaataggaccacgaagcggaactcgccaaagaactctgaaaatctgaccacaaccgagaccatttgccgcaagaacatcctggccaacatggaaaatctgccttcggataatcagaacttcgattccgaaaaactggacctgccgcagccgcataattccgggaatcaggagctggagaaccatctgatcttctgggacgaactagttaatgtcctggccaagttcgcgacgtcaaagaaccagagcctgaagaatcgcacgacaaagaggaacagccctaagaactcggaaaatctgaccacaacggagacaatctgtaggaagaacattctggcaaatatggagaatctgccatcagacaatcagaacttcgacagcgagaagctcgatctgtcacagcctcacaactccggcacacaagaactggagaaccatctgatcttctgggacgaactagtaaatgttctcgccaagttcgcggcctctaagaaccaaagcctgaaaaatcggacaactaagcgcaactcccctaagaacagcgaaaatctgacaacgacagagacaatctgccgcaagaacattctcgcaaacatggaaaatctgccatctgataatcagaacttcgatagcgaaaaactggacctgccacagccacacaactccggcacgcaagaactggagaatcatctgatcttctgggacgaactagtaaacgtactggccaagttcgctgcgtcgaagaaccagtccttaaaaaaccgcaccactaagcggaactcacctaagaactccgaaaatctgaccacgactgagactatatgtaggaagaacatcttagccaacatggaaaatctgcccagcgacaatcaaaactttgactccgagaagctggatctgccgcagccgcataactccgggaatcaggagctggagaaccatctgatcttctgggacgaactagtaaacgtcctggctaagttcgccgctagcaagaaccagtccctgaaaaacaggactaccaagaggaactctcctaagaactcagaaaatctgactaccactgaaactatctgtcgcaagaacatcctggctaatatggaaaatctgccgtcggataaccagaacttcgattccgagaaactggacctgcctcagccgcacaattctggcaaccaagagctggagaaccatctgatcttctgggacgaactagtaaacgtgctcgccaagttcgccacctccaagaaccagtccctgaaaaataggaccacaaagcgcaactcgcctaagaactctgaaaatctgacaaccacggagacaatctgcaggaagaacatactcgcgaacatggagaatctgccttcggacaaccagaacttcgattcagagaagctggatctgccccagccgcataattccggcaaccaggaactggagaatcatctgatcttctgggacgaactagtaaacgtattagcgaagttcgctacctcaaagaaccaaagcctcaaaaataggacggccaaggggaagagccctaagaactcggagaatctgactaccactgagactatatgtcggaagaacatcctcgcaaacatggagaatctgcccagcgataaccagaatttcgattctgagaagctggacctgccgcagcctcataattctggtaaccaagagctggagaatcatctgatcttctgggacgaactagtaaacgtactagccaagttcgcgacctctaagaaccagagcctgaaaaaccgcaccaccaagcggaactccccaaagaacagcgaaaatctgactactaccgagacgatatgtcgcaagaacattctcgctaatatggaaaatctgccatcggacaaccaaaacttcgactccgaaaaactcgatctgccgcagccgcacaattccggtaaccaggagctggagaaccatctgatcttctgggacgaactagtaaacgtactcgctaagttcgccacttcgaagaaccagtcccttaaaaacaggaccaccaagaggaactcacccaagaactccgaaaatctgacgaccaccgaaaccatctgtaggaagaacatactggctaatatggaaaatctgccttctgacaaccagaatttcgacagtgaaaaactggacctgccccagccgcataactctggtaaccaagagctggagaatcatctgatcttctgggacgaactagtaaacgtacttgcgaagttcgctacaagcaagaaccagtccctcaaaaatcgcactgccaaggggaagtctccgaagaactcagagaatctgaccacgaccgagactatttgtaggaagaacatcctggccaacatggagaatctgcccagtgacaatcaaaactttgatagcgaaaaactggatctgccgcagccacacaactccgggaatcaggagctggagaaccacctgatcttctgggatgaactggttaacgttctcgcgaagttcgccacttccaagaaccagtccctcaaaaacaggaccactaagcgcaactcgccaaagaactctgagaatctgacgaccacagagacgatatgccgcaagaacattttagcgaatatggaaaatctgcccagcgacaatcagaactttgactccgaaaagctggacctgcctcagcctcataattctggaaaccaagaactggagaaccacctgatcttctgggacgaactagtaaacgtactagcaaagttcgccacctcaaagaaccagagcctgaaaaatcgcaccacaaagcggaacagcccaaagaactcggaaaatctgactactactgagacgatttgtcgcaagaacattttggcgaatatggagaatctgccaagcgataatcaaaacttcgattctgaaaaactcgatctgcctcagccacataattccggcacccaggagctggagaactccgacatcttctgggataagattgtgtccatcgagccggtcggggagaagcaggtgtacgatctcactgttccagagactcataacttcgttgctaatgatatttgcctccataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2974 - DNA, 2298 bp, Artificial Sequence
  Synthetic Construct, AT-131 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcggggtctacaaaggtcattgacgctgctacggggaatctcttctcgctcaaggagatcgccgctcagcctgagtactggctctcgcgcaaggtcttctctctcgacctgaagtcacagcaggtggtccagcagccaatcaccgagattcaccctaatggcgtgagggatgtctggcagatcaccacgaggaccaacaggaaggtgtgcgctacggacgatcatctcttctacacagtcctgggctggaagccgctcaaggacttcagcgttggcgatcgcctcgggctgccgaataagatccccattaactacaggtcccagatctccgacagcaaggtgaagttcacggcgtacctcattggcgaggggtacctgtacacaaattcgttctcttgctcatacttctgcaactccgacggggagctcatcgcggatttctacggctgcgctgaggagctgttcgggtccagcgctccaatcgagaagcagctccacctgggcaataagtccgtgatctacgtgcggatcggcctcatttccgggctgaagaactgggtcgactcctacctccagtgcgcgaatagccgcgtgcaggagatccccaactggattttctccctcagccagtcgcagctccagctgttcctcggcatcctgtggtctacgtcagggatcttcgacgagacaattggctacacttactactcgtctaacagcgaggtcctggttaggcaggtccagcatctgttcctccggctgggcatcgtttccctcttcaacgtcaataaggttaagggccagggggagctggacgtgtcctacgttgtggaggtccgcgggagggaggatatgctgaagttctacaagctcatcaagccgtacctgtcatcctacaagcagggcctctgcgagagctgctacctggtcattaagtaccagcagtcgtaccagttcaagtacttcctcactcccgacttcttcgatctgatcgtgaaggctaagaaggccagctcgatgaccagggctctcggcgtttgcggcggggagatctcttcagtgtggaacttccagaatacatctaaccggtccctgagcttcgacaagttcaacaatttctcgactgtcctcgcggatgaggagctgaccgccatcgcgaactcggacgtgttctgggatgagatcatttctatcgagtacattggcaaggaggaggtgttcgatctcactattccagagactcataacttcattgctaatgacttcatcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2975 - DNA, 1425 bp, Artificial Sequence
  Synthetic Construct, AT-132 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacttacgagacagagattatgacagtggagtacgggccgctgcctatcgggaagatcgtggagtaccgcattgagtgcacggtgtacacagtcgacaagaacggctacatctacactcagccgattgcccagtggcacaatcgcggcatgcaggaggtctacgagtactccctggaggatgggaccgttatcagggcgacgccggagcataagttcatgaccgaggacggccagatgctgcccatcgatgagattttcgagcggaacctcgacctgaagtgcctcgggaccctggagatggttaagattgtgagccgcaagctcgctaagacggagaatgtgtacgatattggggttacaaaggatcacaacttcgtgctcgctaatgggctcattgcttccaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2976 - DNA, 2304 bp, Artificial Sequence
  Synthetic Construct, AT-133 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgacgggggatcagaaggtcctctactacatcgctaagaagctctactacgagacattcgctgagtgctacgaccgcattaacggcgacatctccagcgttagcgtgccatgcttcgatgagaactaccagacagtgattaagcctatctcggccatttggaagcaccatgtgaagaagaagggcttcaagattaagatcacttgggggaagcagattaagatcacagaggaccacagcctgttcactaggaacgagaacaataagccgcaggcggttttcggcaatgagatcaaggtcggcgatgagattgggatcccctcctacatctccttcctggagcagccgctggagcccttccatattaccgacaagattctcatccaggaggagatctacgtggagtcagaggacacgatctcctacattgagaagtacggcgataagatgcgggagtacctcctggcgaagtcgctgtctccgtcacagttctactccattctcaagacatacgaggctaagaaccagatcccgtggcacctgtggaagtacctggagctgcccctctccgagaaggacaaggtctgctacctcagcaagaaggccattaagaactggatcgataatgtcgaggagctcctgtggttcctgggcttctacgttgccaggggctcactgatcaagaacgaggtggtcctcaagggcgagccatcccagctggagaaggtcatcgagctcattgagaggatcttcgagtacaagagcgagatcaatgactcgggctacatttcgatcaagtctaagattctcgttgatctgatcggctacgggctcaacttcgggaatcaggagaaggacattccaaactggatcctgcagctccctgagcagcagctcatccggttcctgaagggcttcgtggctgggaacaacctggagaaccagctgaatttctacctggagttcaagacggactctcagctggtggcggagaagctggtcctcatcctgtcgaagttcggcctcgtcgctgacgtttctgagatcgaggttaacgaggaggatattgccaagatctaccgcatcattatcgagggcctggaggacaagaacatccataatctctctaaggtggagcagaagatttcagctctgaccacgggcgatatcgcttgggggaagattgagtccatcgaggagttcgagatcgacgattacgtctacgacttctctgttccaaactacgagaacttcatcgggggctcttacaatgttttcgctcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2977 - DNA, 1983 bp, Artificial Sequence
  Synthetic Construct, AT-134 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggatacgctgctgattacaagggactctattcataagattaaggatgtcgtggggcagaagattgagatttggaatggcaagaactggtctcaggtcatcccgctgaagacagggaaggacaggaagctctaccgggttcgcttcggcgacgggtcgtacctggatgttaccgagtaccaccgcttcttcgtgaaggacaggttcggcaagaagtacgaggaggtgcagaccaaggatctcctgacgcactccaagtacgccctggacgtcgagccattcatcattgattaccatgacggcgattcgatcaacctctcttacgcttacacactgggggctgctctcggcaatgggactatcgaccagaactctaatggcaagattagggtgtactcacataaggccgagctgatcttcgcgggcaacaagtccctggagcggcagtacaattacctcccgagcttcgtggacgtcattgatctcggcttctcgggggagctcctgaggaggctgcagaccgagcccgacgctctcaacacgatcgcctcatggaataagtccgctatcctggccttcattgcgggcctcgctgacacagatgggagcgagactaagggcaacgggatcaagatttccgtgagcgactacgagagggccaagcggctgcagctcctgctcacgaagtgcggcattagggcgagcgtcaatctgatggcttcgcggggctgcaccacgaacctcggggagcgcaatcaggacctgtactacctccagatcaccgattgccgggagattccatgccagcgcctcgacacaactaaggtttgcgaggcgaagttccagggcaagtaccagaccatccagaacgtcgaggagctgcctggcctccacgatacgtactgcttcgaggagccagagttccacaagggggttttcggcaatgctctcacaggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2978 - DNA, 2157 bp, Artificial Sequence
  Synthetic Construct, AT-135 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggacaagacggctctgcggattttcaatcaggggctgctctacgcggatgaggtcgtgacaccgggctcgggggagacagtcggcctcgggctgacggtcaggaacggcatcggggcgtccacagccattgcgaatcagccgatggagctggttgagatcaagctcgctaacggccggaagctgcgcatgacccctaatcaccggatgtccgtgaagggcaagtggattcatgcctgcaacctcaagccggggatgctcctggactacagcatcggcgagtaccagaagcgcgaggacaccctcctgattcctctccagctggaggattacactgaggtgaacaattcgcagaccctgggccacaacggcggggtcctcaccaagaagatcatgacgccggcgtcaatgacatccgacctggcttacttcctcggctgcctgttcggcaacgggtgcatcgtccagaataagtaccaggtttgcttctaccattctcggctcgacgtgctgtacggcctccaggagaaggggaagaagctgttcggcatcaaggggtctctcaacgatttcgccaatggcaggttcgagctgtgcttcgcgtcacggcagctcttctactggctccacctgaaccagctggtcaagacgcagaagtcagaggacctggagcgcatccccctctccctgaggaggtccagcagggttactctcctgtccttcttctgcggcctgattgacaccaacggctacgtgccacaggatggcaagctcagcatcgcttcggcctcgtctgatttcattcataacctgcagcagatcggcgagtccattgggctctgcttcagcatctaccagaatacgaagggggagaacctgcagaatcagcacaacaatacatggggcctctgcctgtctcccatgctctcaaacgtggacgcgctggattacctcaaccataatagcatcaagtgccaggagggcccggtggtcatttcgaagtgcgtcctcaactactcgccctacaagatcgagtctgttaatattggcgctgtgtgcgactacagctacgatttcgccatcgagggcatcaatgataatgactcttggtactggcagggggctctcaagtctcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2979 - DNA, 2421 bp, Artificial Sequence
  Synthetic Construct, AT-136 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgctgcatgacactgagatctacgtgaatggcatggttatggaggcggagcagatttggcaggcttacgcgggggaggcggagttcgacggcgaggggttctggacagagccgaacaaggagctcctggttaatagcctcgatgagaccacgggcaagatcgtgttcgcccggattcgcaggctgtaccgccagtgggttagggagaagctcaggaaggtgcggctgaaggacggctccagcatcacaattacttgcaggcacaagctcttcatccgggactcctggaagaacgatttccaagtgggcgacgatgtctgcgttcccgcgaagctgatgtgggacgggaagccagaggacccagatgtggtcaagttcgtcgcttggcaggttgctgagggctgggagagggtcaattccggcatgttcggggttagccagaagggcaaggacgtgctggaggggctcctggaggtcttctcgcggctgggcaagcgctacgatatcaagattaactgcccaaaggttgtggcgcacgggtctaagaagaattgctacgagttcagcgctcattcgctggagtacaggaagttcctggaggagaagcgctacggctgggggaagaggtcccatgagaagaccatccctctgttcattatgcaggccgacctcgattcggtgcgggtcttcctgtctaactacttcgacgcggagggctgggtgaataagaccgttcgctgcgtggagatctccacggcctcgtctcagctcatccaggagctgagcattctcctgcggcgcttcggcgtctggatgaagatctcaccgcagcagaagtgcgctaccaacggcacgggggttttctgcacatactacatcgggactttcggcgggaatagcgccaggtgcttcctccaggagatcggcttcaacgacagcgggaagcaggagaatctgaagtcgatctgcgagaagattgcggactctaacgtggagggcatcccggcttcagatattgtggccgagctcgtcgagaagacccagctcccagtcggcagcctggggatccaggaccctatctacatggacggctgccaggatttctctcccacgtcactggagaaggtcatcaactcaattgaggatatcatttccggcgctggggaggaggagtacggccagctcaagtcatccaagctgaggaacaagacactggaggcttactcgctcctgaatatcctggagctggagatctacaagactcggctccagaagctcctgaaccaggaggtgtactactgccagatcgagtccattgaggagatggagtacgagggctgggtctacgacttcgaggtttccaagtaccacaatttcgttgctaacaacatcatttgccacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2980 - DNA, 2181 bp, Artificial Sequence
  Synthetic Construct, AT-137 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggttacgggggatactgaggttactattaggcggaatgggcggattgagttcgtccctattgagaagctgttcgagcgggtggatcaccgggtgggggagaaggagtactgcgtgctcggcggggtcgaggctctcacactggacaacaggggcaggctggtctggaagaaggtcccatacgttatgaggcacaagactgataagaggatctaccgggtgtggttcacaaactcctggtacctcgacgtcactgaggatcattcactcatcggctacctgaatacctccaaggttaagccagggaagccactcaaggagaggctggtggaggtcaagccagaggagctcggcgggaaggtcaagtccctgatcaccccaaaccgccctatcgccaggacgattaaggccaatcctatcgcggttaagctctgggagctgattggcctcctggtgggcgacgggaactggggcgggcagagcaattgggcgaagtactacgtgggcctctcgtgcgggctggataaggctgagatcgagcgcaaggtcctcaacccgctgagggaggcctcggttatttctaattactacgacaagtccaagaagggcgatgtctcaatcctctccaagtggctggcggggttcatggttaagtacttcaaggacgagaacggcaataaggctatcccgtctttcatgttcaacctcccccgggagtacattgaggctttcctcaggggcctgttctccgctgacgggaccgtgagcctgaggaggggcatcccggagattaggctcacgtcggttaaccgggagctgtctgatgcggtgcgcaagctcctgtggctcgttggcgtgtccaacagcctgttcaccgagacgaagcccaatcgctacctggagaaggagagcggcacccactcgatccatgtcaggattaagaacaagcaccggttcgccgaccgcatcggcttcctgattgataggaagtctacaaagctctcagagaacctgggcgggcatactaataagaagagggcgtacaagtacgacttcgatctggtgtacccgcggaagatcgaggagattacgtacgacggctacgtctacgatattgaggttgagggcacacataggttcttcgctaatggcattctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2981 - DNA, 2280 bp, Artificial Sequence
  Synthetic Construct, AT-138 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgaccgctgatacttacgtttggacagatcgggggctggagacagtcgctgaggttttcgggcgggcggggctccctctctcatccactagcagggttaccgacgtgagggaccgggatatccgggtggtcaacgagaagggcgagctggagcaggtggctgctctcacgcataatgggaggcagccagttgtgaggatcacagtcgcttccggcaggcaggtcacggttacacggaaccaccctctgcgcgtcatgaatgacgatggcttcattgtttggagggaggctgggcagctgagggagggcgacgtgctcgtctccgctgccttcggcgctgtccaggctgcttcgggcgggggcctctctgaggacgaggctgttctcctggggtacctgaccgctgctggcagcctcgatccagctgggcatgtgtgcttcaccacgacagacatcgagacaggcgctgagttcgctgctctggctgagtggctcctggacactaccgtcactgctgttccaggggatggccaggtggcctacgtgctgtccgacccagctgctaggcacacgctcgctgagcgctacggcgtggattacgctgctgctgctcggatcccgcagtgcgtccgcactgctggcgacaagatgcagagggctttcctcgctgctctgtacaccgctgctggctggactgacaccagcgctgccgttgggctgaggacggcttcggctccactcgcgagggaggtgcagtacctcctgtacgggctgggcatcccagccgacctcgataggtctcacgggaacggccagcatccttgggctgtgaccatttcaccagctgctgctccaaggttccacactgaggtcggcttccgcaccgctcagcagtcgccacagacggggctgcatgagccaacaccacaggtggaggctatcccaaatctcacgggcctgattcacgctctcagggactcaatcggggatcgggccgagtccacagacgatccattccctgctgctagcgggggcgcttacgacagggatcaggttcgccgcgtgatcgactgggctaagaggaggactgatgaggctccagctaccgctaacgctatcctcggctacctgacgcagctcacagatgccaggtacacgtacgagccaattacagccgtcgaggacgcgggccagcagcctaccttcgacctcatggttccaaggactcatagcttcctcgccaatggcattctctcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2982 - DNA, 2085 bp, Artificial Sequence
  Synthetic Construct, AT-139 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatgcactacgacacactcgtgacactcgctgacggcacacaggagaagatcgggacaatcgtggaccgcaagctggacgtggaggtcctgtcgtacgatccagagaccgacaggatcgtgccaaggagggtggtcaactggttcgataatggcgccgcggaccacttcctgcagttcactgtgggcaggtctgggaagccaggcggggctcagttcaccgctacgccaaaccatctcatcaggacccctggcgggtggagggaggctggcgagctcattgctggggacagggttctggtgcacgagccacattacctcaatgagcagcagaggcaggttgtgtacggctcgctcatgggcagggggacgctggtcccagataggcacggcgggcctggcgttcacttctgcatggctcatacagccgagcaggctgcctacctggactggaaggtctccctcctgggcaacattgcccactcacgcaccgctgaggcttccgctacggtcggggttgagttcacaccgatgcccgagctcagcgagctgcatagggtcgttgatttcggcgacgggcacacccatctcacgtgggagttcctcaagcagctgacgccactcgcgctggctgtgtggtacctcgatgcgggcacactgactatccctcagtccgggactgacgatgacgccagggtgcagattgacgtcgagaccctgtcgccaggctctcggcagaggctcgtcgagtacctgagggatacccacgagctcgacgctgctgtggtccagcagggcgctgacgcgaggtctctcctggagttcacaccagctgctaccgtgcgcttcctggagctggttgcgccatacgtgcctgagtcaatgtccagcatgctcctggctcagttcaggggcaggtgcagcgtcacgccagagtactcggatccagtccagaggctcgttgctgctccagtgctggacatccaggtgaagcccggcagcacacgcaagttcgacattgaggttgagggcaatcataactacttcgtggatggggtcatggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2983 - DNA, 2625 bp, Artificial Sequence
  Synthetic Construct, AT-140 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgctgcctgaggagtggattccgctcgtggagaatggcaaggttcggctgcatcgcatcggggagttcgtggacaagctcatggagaccgacagcgagctcgtcaagcgcaacggcgataccgaggtcctggaggtgcgcgggatcagggctctgtctttcgaccggaagtcaaagaaggcgcgcgtgatgccggtcaaggctgttattcggcaccgctactccggcgatgtgtacgagatcgtcctcggcagcgggaggaggattaccgtcacggaggggcattcgctcttcgcttacggcgacggggagctgagggaggtgacaggcggggagatcaaggctggcgatctcctggctgttccaaggagggtgaacctgcccgagaagaaggagcgcctgaatctcgtcgagctcctgaggaggctcccagaggaggagacaggcgacatcattctgactatccccgtgaagggcaggaagaacttcttcaaggggatgctgcggacactccgctggatttccggcgaggagaagaggccaaggactgctaggaggtacctggagcacctggagggcctgggctacgtgcgcctcaagaagatcggctacgaggttaccgacagggaggggctggagaggtacaggaagctctacgagaggctggtggaggcggtccggtacaacggcaataagcgcgagtacctcgtggagttcaacgctgttcgcgacgtgatcgccctgatgccggaggaggagctcagggattggctggtcggcaccaggaatgggttccggatgaggcccttcgtggagatcgaggaggacttcgctaagctcctgggctactacgtctcggaggggaacgccaggaagtggcggaaccagaagaatggctggtcttacacggtgaagctctacaacgagaatcagcgcgtcctcgacgatatggagtccctggcggagaggttcttcggccgcgtgaagagggggaagaactacatcgagattccaaggaagatggcttacatcattttcgagaacctctgcggcaccctggccgagaataagcgggttccagaggcgatcttcacgtcgcctgagtctgtgcgctgggccttcatcgagggctacttcattggcgacggggatgttcatccttctaagagggtgcggctgtcaacgaagtccgagctcctggtcaacggcctcgttctcctgctcaatagcctgggggtctcggccatcaagattcgccacgactcaggcgtttacagggtttacgtgaacgaggagctcccattcacagattaccgcaagaagaagaacgcgtactactcccatgtcatccctaaggagattctggaggagactttcggcaaggtgttccagcggtccgtcagctacgagaagttccgcgagctcgtgaagtccgagaagctggacggcgagaaggccaagaggatcgagtggctgctcaacggggacgtggtcctcgataaggtcctggaggttaagaagcggccatacgagggctacgtgtacgatctctctgtggaggaggatgagaacttcctcgctggcttcgggctgctctacgctcacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2984 - DNA, 2019 bp, Artificial Sequence
  Synthetic Construct, AT-141 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcctaccatcatgatttcgagctgctgctggctgacgggcgcaaggttaagatcggggagctggtggacaagctgattgagaagaatcgggaccgcgtcatcctgggcaaggataccgagatcctcccggttgaggacattgagctcctggcctacgatctggagaagagggagatcgttaaggtgaaggctgaccgcgtctcaaggcacaaggctccagagcgcttcatcaagctcaggttctccaatggccgggagattaccgtgacgccggagcatcccgtcatggtttgggagaacggggagatcacagagaagccagcggagaagatcactcctggcgatattgctctcggggttctgcgctacccgattcaggtggacggcaagttcaaggagaggtaccgggatatgagggaggcggaggactaccaggattacctgtactcccggggcgtggtcagcaagatcaagcgcaccgggatctacttcacggtggagaaggctaggagggctctcccgcgggagctggtcaagcccctcatcaacgctggcaagattctcagggttacacagactccaaaggagcgggcgagcttcaatcagaagctggtccgcgagaacatcattgaggggtacctccagaggatcattgagcggatggacgagctggagaggctgtcgcgcgaggatccagctaaggctctggagctcctgcctaagacccagctctactacaagtacggcatcacgtacgggaagctcaagaagctggctgaggctcgcaactcctgggctgagggcatcattcagtcggcggtggctgagcgcatctctctggccaagagggagctggaggagttcttcaagtggtggaacgcgaatgtcaacttcctgaaggtgaagtgcgtcgaggagatcaagaacgaccgctgggagtgggtgtacgacgttactgtggagcctcatcatctcttcgtttcgcatgggctcgttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2985 - DNA, 2223 bp, Artificial Sequence
  Synthetic Construct, AT-142 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatgcatcctgacacatacgtggttactaagtcgggggctaagaaggtctctgagctgactgagggggatgaggtcctgacacataccggcacgttcaagaaggtcatccagccactgaggagggagcacaaggggcgcctcctggttatcaaggcctacggcaccgtgcctgtcaagattacgccggagcacatggtttgggtggtcaagcagatcaggcacaagtcccattacagcgatgggcggcaggtcatttggtgggagttcgagggcccagagtggatgacggctcaggagctgaaggagcgcctggagtccgagacagacccaaaggtgagctacatgctcctgcagccaatccctgagccgtccgtggacgcggataagattcctctgaggaaggaggtctacgttgtgaaccagcacggcaagacagacaagctccatccgtccgtgaagcggactcccgagtacctgccactcaacttcgagaccgctaggctgatcggcctctggattgctgaggggtcaacttccaagaacggcgtcatcaagttcgacatttccagcaatgaggaggatctgacggagttcatcacaggcactattaggaagtacttcccgcacgctaagatcgtcgttaaggaccatgagaggaacaggaggacggtccggttctgcaataagcgcttcgcggagtggctcagggagaacatcggccacggggctgataataagagcattccgcccctcctgctcctgaacaagaatagggaggtgcgcctgggcctcctgagggggctcatcgagggcgacggctacgtgcgcagggagtcgcagcgcagggcgaactacatcagctactcgacagtttctccctcactggcttaccagctccagctcctggtggcttcgctgggctacacctcgtctatccacaggtctattcggacagagggcatcgggaagactaggaagcccatctacgatgttaaggtgtcgggcaagtcttactactcactcctggaggagctcgggttcgaggtcccacagaggggcaacaggacctacaacgttaatcgcacgtggaagaattacctcctgctcaaggtgaggtccatcgaggaggaggagtacgagggcgacgtttacaatctggaggttgagggggatgagtcaggctctgtgggcttcatcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2986 - DNA, 2652 bp, Artificial Sequence
  Synthetic Construct, AT-143 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgctgccggatgagaaggttattctccctgagcatgggcctattacactcaaggggctcttcgatctcgctaaggagacagtcgtggctgacaacgagaaggagatccgcaagctgggcgccaagctcaccattgtgggcgaggatgggaggctcagggtcctggagagcccatacgtttggaaggtgcggcaccgcggcaagatgctgagggtcaagctcaagaactggcactcagtgtccgtcacgccagagcatcccttcctgaccacgcggggctgggtgcgcgctgaccagctcaagccgggggattacgttgcggtgcccagggtcatccatggcaacgagtcagacgagcggttcgtctccttcgtttacgagaagctcaagaatgatgagctgatcgcgaagctccgcggcgaggtgctgtccaagatttccagcgagttcaagggggacagggcttacaaggttgagaggaacgtgttccggtgggaggacatcgagcgcctcaatctgtgggatgaggtggagagggtcgccttcaccccaaggatgcacaggagcggcaagccactgcattacgtgaagctcccaaggtcgcctgaggagtgggaggctttcttctacttcgctggcgtcatgttcggcgacgggtcccaggataagatcgccaacaatgacgtcgaggtttacgaggagctcaagaagctgtctgttctcggcgtggctgtcaagagggtggagaggacaacttcatacgagatcgagctcaccaacgggaagaatgctctcctgaggctcctgagggtgctgttcgagtacccggagcggcagaaggcgaagtccattagggttccacggatcctgttcattgctcctcgcaagtatgtgtcccgcttcctcaggggctacttcgacgcggatgggcacgtcagcctgaaggacgcgaggatcgaggttacgagcgcttcgcaggagttcctggaggatctcagcctcctgctcctgcggttcggcatcgtgtccaagatctaccgcagcgactacaccacgctcgttatctcgggccgcaggaacctcgatctgttccggcgctacattgggttctctgtcaagaataaggccgaggcgctggagaaggccatcaagaagtcaaggcggtctgagtcataccccattttcgaggagctgaagaggctccggctcctgttcggcttcacacgcactgagctcaacagcaatgtgccattctacgggaagtacgagtcggaggaggccccttcttacgagacactgatgaggatcctcgacgcgattgagaagggctcgatcaacctggataagaagattgctgtcctggaggggcgcatcagggaccataattacattaaggccttcgagaaggacggcctgatcaaggatgggaagctgactgagctcggcagggagctcctggaggtctggaggaacagggagttcgactcgtctgacgtcgattacatccggaacctggcggagaatctcgtcttcatcccggttgaggacattgaggagttcgagtacgagggctacgtttacgacgttactacagagactcataatttcgttgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2987 - DNA, 2589 bp, Artificial Sequence
  Synthetic Construct, AT-144 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggactcaaagatcctgacagggaaggggccagtggagatcgggcggctgaactctaacatgatcgcgggcatttggcgcttccagaccgagctggtgcggttcgaggagccacaccgcgttgagtaccgcagggagggcgtgaagatccgcacgaggctcgggttcgagattaaggccaccaaggagcataagttcctcacggtggacgagaacggcgagctgcgctgggtcgaggcttggaagctcaaggagggcaactgggtcggggtggtccggcgcctgccatctcctaatgtgaaggtctcaatcctcgacctcctgccgcccaacgcctacctcaagctgaagggcgagttcctgagggagctcaagctgtcgatccaggcgaagttcggctctattaggacatacgccaagaagaagcgctggtcagagtcctacctcgtcaagcagctgaatggcgtttacccgttcaggtgggagaggctctccgctgtgctgaaggacctcgatctgcgcatgacagagaacgacgtcgagaggatcacttccgataagggcaagtacagcctcccgatcgagttcaccccctcaatggctaggctcctgggcttctggatggctgacgggtcctggaagggcgggaccctcacgctgttctccagcgataggaagatgctggagaagtacaaggagctgtgcaaggaggagttcggcgttgtggggcggatccgcatgctcaacgagtctacatactcactggagatctctttcaatctcctgccggctattttcaagaacctgacaggcaatactgagcgcaagagcaagctcgggactttcccatccatcatctacagcctgcctgaggagcacaagagggagttcctcgcgggctacttcgacggcgatgggttcctggaggttaagggcgggagggtgtactcggctggcttctctaccttcaacaagaggttcgcggagggcatccgggacattctcctgcagctcgggatcgtgtcgtctattagggcccgggagtacgatgaggtccagaagttcaagggccgcgttatccccaagaagggggcttcatacacggtttccgtgctcggcggggagtacctgaagaggttcttcgacgccgtccgcccatggaggtcggattacgagggctgggaggggatgtacaacgagggctacagcaattcggacgtcgttcccaacctcggcaagcgcctgaggagcatcagggagaggctgggcattagcgcttaccgcatgtcgaagatggggttctacaatccagtccgcgttgagctgggcgagagggagatctccaggcggaacctcaggctcctggtggagttctacgagcgggtcgcgaaggagaagcgcgtggaggacgtcctggaggagctgagctacctcagggagctggctgagggcgacgtgttcttcgatcgcatcacgtcggtggagcctgcctacattgatgtcgcgtacggcatcatcaactcggagacagagaactacatcgtggagggcttcatttccaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2988 - DNA, 2622 bp, Artificial Sequence
  Synthetic Construct, AT-145 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctattctgcctgaggagtggctgcctgttctggaggagggggaggttcatttcgttaggatcggggagctgattgaccgcatgatggaggagaacgctggcaaggtcaagagggagggggagaccgaggtcctggaggtttcaggcctggaggtgccgtccttcaaccgcaggacgaataaggcggagctgaagagggtcaaggctctcatccggcacgactactctggcaaggtgtacaccattaggctgaagtcaggccggcgcatcaagattacgtcagggcattccctgttcagcgtccggaacggcgagctcgttgaggtgaccggcgacgagctgaagccaggggatctcgtcgctgttccaaggaggctggagctgccagagaggaaccacgtcctcaatctggttgagctcctgctcggcacaccggaggaggagactctggacatcgtgatgacgattcccgtcaagggcaagaagaacttcttcaaggggatgctcaggacactgcggtggatcttcggcgaggagaagaggccaaggactgctcgcaggtacctcaggcatctggaggacctcggctacgtgcggctcaagaagatcgggtacgaggtcctggactgggatagcctcaagaattaccggcgcctgtacgaggctctcgtggagaacgtccgctacaacggcaataagagggagtacctggttgagttcaattcgatccgcgacgccgtggggattatgccgctgaaggagctcaaggagtggaagatcggcacactcaacgggttccggatgcgcaagctgattgaggtcgatgagtccctcgccaagctgctcggctactacgtgagcgaggggtacgcgcgcaagcagaggaacccgaagaatggctggtcgtactctgtcaagctgtacaatgaggaccccgaggttctggacgatatggagcggctcgcgagccgcttcttcggcaaggttaggcgggggaggaactacgtggagatccccaagaagattggctacctgctcttcgagaatatgtgcggggtgctcgctgagaacaagcgcatcccagagttcgtcttcacatcacctaagggcgttaggctggccttcctggaggggtactccagcgctatggctacctccacggagcaggagactcaggcgctgaacgagaagcgcgctctggccaatcagctcgttctgctcctgaactcggtgggcgtctctgctgtgaagctcggccacgactccggggtttacagggtgtacatcaatgaggagctgccattcgtcaagctcgataagaagaagaacgcttactacagccatgtgattcctaaggaggtcctctcggaggtcttcggcaaggttttccagaagaacgtgtccccacagaccttccggaagatggtcgaggacggcaggctggatcctgagaaggctcagaggctgtcgtggctcatcgagggggacgtggtcctcgatcgcgtcgagtctgttgacgtggaggactacgatggctacgtgtacgatctctctgtggaggataatgagaacttcctcgtgggcttcgggctcgtttacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2989 - DNA, 2460 bp, Artificial Sequence
  Synthetic Construct, AT-146 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2990 - DNA, 2481 bp, Artificial Sequence
  Synthetic Construct, AT-147 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacccctgacacactcgtttcgctcgctgacgggcggattatggagatcaaggatgcggtggagaagtcggagggcaatctgctcagcgtgaacggcctgaagccgaaggaggccaaggcgctcaagttctgggagatcgactggaacgggcccctcaaggtcatcaagctgaagaatggccacgagattaaggccacgccagaccatgggctcctggtcatgagggagggcaagctggggtgggtttcggcgaagaacgtgagggagggcgactacgtcgctttcgcttacaataccggccacagggggagggatgagtacacgctcctgaagctcatgatcaagctgggcattaccgacgtgatggtcgagctcgatgaggagtacttcaacgagaaggttgcccctatcgtgagggagcggatttccacaagcactaagtacaagtacctgaggaggagggtcctcccactgtacctcctgcaggagtggggcctggacgattacgaggcccatgttaagtccctctacaggcagagggctggcagcaagccaatccccaatttcaagctcgacggcaggttctggtatgtgttcgggctcgttctgggcgacgggacactccgcgatagcaaggtgctgatctcgcagactccactcaaggacgtcaagtccgttctggaggatgtcttccctttcctcagggttttcgagaccacgaaccaggttggcttctccaactccatcatcgctgaggtgttccgcaggctcggcgctaggaaggggaagctccacccactggtcttcggcctgagggaggagtacatcaacgcgatgattgctggctacttcgacaccgatgggacgttctctatcctcaacgacaggaagggcccaaatttccgggggatcctgacatcaaagcggggcgatgtgctccgcatgctgtccgtctacctgtaccagatcggcattatgaactacctcaggagggacgagaggaccggggtgtgggatctgatcatttcaaatcgctccctggagaagttcagggagaagatctacccgtacctccggattaggcgggctcagttcgacgaggcctactctgtctacagggcctcacgcagggctttcgagggcgatctcctgccagtggcccctgtcttcggcaagctgaagttcaagaacgggacaaagaatcgcatcctcaaggagactggcattgacgtgtggaactggctgaagaggccagagggggagatcccccgcgataagctctccaaggtcctggagtacgctgaggagtcgcccgagaaggagttcctcaagtctctggtggaggcgggcgtcacctgggttaaggtgaagggggtggaggaggagctgtacacgggcaagctctacgacttcacaactactacggagaatttcctctcaaatggggctgtttctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2991 - DNA, 2376 bp, Artificial Sequence
  Synthetic Construct, AT-148 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatcgatggcaacgctaagattattttcgagaatgacggggaggagcatattatgacaatggcggagatgtacgagcgctacaaggatctgggcgagttctacgacccggagtacaaccggtgggggatcaatgtggaggaggttccggtctacgtgaagtcattcgatccctccaccaaggagattacgaagggcaaggtgaaggtcatctggaagtacgagctcggggaggacgttcccaagtacgagatcaagacaaacaagggcactagggtcctcacctcgccatggcaccctttcttcgtcattacgcaggatctgaagatcgttgagaagcgggctgatgagctcagggagggcgacatgctggtcggcgggatgccatctgacgatgactacgagttcctcctggactactggctcgccggcttcattgcgggcgatgggagcatcgacaagtaccgctcgcacgttaagggccatgagtatgtgtacgatcggctgcgcatctacgactacaccacggagacgctcggcatcattaacgaccacctggagaagacattcgggaagaggtactccctccagagggatcggaatatccactacatcgacattaaggccaagggcattactagccattacatcgagctcctgcgcggcatcaccaacgggattccgcagcccatcctgaaggagggcaggaatgctgtgctctctttcatcacgggcctgttcgatgccgaggggcatgtcaactcaaagccaggcgtggagctcgggatggtcaataggaagctgatcgaggacattacatactacctcaacagcctgggcatcaaggcgcgcatgaggaagaagcctcggaaggatggggtggactacgtcatgcacgttgaggagtactccagcctcctgcggttctacgagctcattggcaagaacctgcagaactccgagaagcgcatcaagctggaggagctcctgtctaagcataacggcgggtcattcggcctcaccctgtccttcgaggacttcaaggcgtggtcgtctaagtacggcgtggagttcaagacgaacgggtcccagacactcgctatcattaagaatgagaaggtgagcctgggccagtggcacaggagggggagggtctcgaaggctgtcctcgttaagatgctccggaagctgtacgatacaactaagtccgaggacgtgaagcgcatgctccatctgattgagggcctggaggtggtcaaggagatcaacgtcactaatgagccaaagaccttctacgacctgactgtggagcgctaccagaactacctcgccggggagaatggcatggttttcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2992 - DNA, 2547 bp, Artificial Sequence
  Synthetic Construct, AT-149 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcatccggactcactcattcctacgcctcagggggttaagcgcatcaaggagctgccggagaagggggaggtcttcgctctcgacttcgatctcaagctgtcacgggcgaggtacaggctcctggagagggacgctgatgagcccatgtacaaggtgacactctccgacaggactgagctctacctgaccgcggatcacccggtcctcgtttacagggacgatcagctgatcttcgtccccgctgaggagctccgggagaacgaccaggtggtcctgttcattaatcgctcagagtactccccaaggaccgagtcgcctacgctcctgggcttcctcctggagaacgccacctctatgaaggactacatcctctacgatccagagttcggcggggtgctgaggaatcgcattaaggacgcgggcctcaagactgagatcctgtggaggttccggattcgcgagcccacctactacaagtacctccgcggcaagatgccggttcccatcgtgaggttcctcctggaggagggcgttgtgagcattgaggagctccgggaggtgttccgcgggttctcgtactctacatcactgactccaatcagcttcgagttctcggaggagttctggtacctcttcggcctggtcgctggcgacgggcacctggctaagaagggggctatcaccattccagccaaggaccgcaccgaggatacggtcaaggcggttaaggagatcgctaactccctccaggtgcctttcgccttcgacgagaagtacaagatgatcattctgcggtccaagagcctcacgaggctgttcgagctcctgggctgcccgtacgggaacaagacagagatcttcaggattccgggcgagatcatggcgaagccagagtggatggctgcgttcctcgctggctactacgacgcggatggccacatcgggacaaagccaactggcgggaagaagtcgcattctcctcagatcgtcctgacgagcaagaaccgcatggccatctacacagtcaagcagatgtggcagctcctgggcgttgggacgtacctctgggagaagaaggacaggaacggcaatttcatggcctacgagctgaaggtgtactcccgcgacgcgtggcggttctacgaggtcatgaagaaccacctccgcatcaagaggaaggacctggagcatgtgaaggaggtcgctattaggaagcggaaggcctactctcaccattactcagttctcaatgtgaagtcttgggagggcaagatcaagtccagcaacgttctgtggaagaagttcgacatgtccaatcagaccgctcacggcagggggatcagcctcgacaagctgcagcgcattgtcgattacctcaccgacacggatctgcgcaggatcgcgatgggcgatgtctacgtgctggggatcaggtccattgagaagttccattaccggggcaaggtgtacgatctcgtcgtggatcagtaccacaacttcattgctaatggggtcgtcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2993 - DNA, 2283 bp, Artificial Sequence
  Synthetic Construct, AT-150 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcctgcgcgggctagggtcgtggattggtgcacagggcgggtcgttcgggtcggggagatcgttaggggggaggctaagggcgtctgggtggtctccctggacgaggctaggctgaggctcgttccaaggcctgttgtggctgctttcccaagcggcaaggctcaggtgtacgctctgaggaccgctacgggcagggtgctggaggcgacagctaaccacccagtctacactccagagggctggaggccactggggaccctcgctcctggcgactacgtcgctctgccaaggcatctctcgtacaggccatctctgcacctggagggccatgagctggatctcctggggttcgctctggctgagggccacctccgccatccatcgggcgtgtacctctacacctccagcgaggaggagctggctgccatggaggaggctctcagggcgttccctaatacgcggatccgcgtcgtttggaggaggggggttgctcacgtctacgtgggcagggtggacaggaggcaggaggctggcgctgtggcgttcctcaggaggatgggcctcctggggctggatgcgaagacgaagaggctcccagaggctgtcttcggcctgccaccagaggaggttgctaggttcctggggaggctctggacaggcgacggcggggtggatccaaagggcaggctgattcactacgctactgctagcaaggagctcgcttggggcgtccagcatctcctgctcaggctgggcctccagagcaggctggtggagaagcggttctcgggcgggtacaagggctacgctgtctacctgctcggcgggctggaggctgctaggaggttcgctgagacagtggggccatacctggtcggcaagcggaggcaggacctggaggctctgctcgcttcatgggagaaggctggcaggtccaccggggatgttctgccactcgcgttcctggaggaggtgagggctgctgttgctgaggtggctcagggccaggtggctgacctgctcagggaggccggcctcgcggaggggctgctctgcctgggcagggggaggagggggctctctcgcgccaccgtcggcaggctggctgccctcacggggtcactggcgctgctccggctcgcggaggctgaggtttactgggatcgcgtcgaggcggttgagccgctcggcgaggaggaggtcttcgatctcactgtggagggcactcatactttcgttgcggaggatgttatcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2994 - DNA, 2328 bp, Artificial Sequence
  Synthetic Construct, AT-151 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcatccggacactctcgttcataccgatcgggggactctcaggctgcgggagctcgtggaccctttcaggcggggctggcagccgcacaccctgagcgttgctacggacgagggctggaggccatcgccagagggctacaacaatggggtggctccaaccctcagggtggtcctggagaacggcctggaggttcaggggacactcaatcataagctcaaggtgctgcgcgaggatggcactagggagtgggtcgagctccaggacctgaggccaggcgattgggtcatctgggttctggacgagcacaccggcacgccagtccagctcgctccactggatgagccactccatcctaacaccacgccaattcgcacacctgaggtgctgactgaggacctcgccttcctcctgggcttcttcttcggcgaggggttcgtgtcgggcgataggatcgggttctctgtccacgaggaggagccaatgcgggaggaggcgaagaggctgttccgggagctcttcggcctggagctgagggaggagaggaagccaggggaccgctcagttaccctggttgtgcggtcccgccctctggtgacgtggctccgcaagaacggcctcctgaaggggaaggcgagggagctggaggtcccgcgggctatcaggcagtccccaaggcctgttctcgctgcgttcctcaggggcctgttcgaggccgacggcacaattactgcggggtacccaatgctgacaactgcgagcaagcgcctcgctcaggatgtgatggtcctcctgggcgggctgggcattccttctaagctcctgaggtacaatccactcccaggccgcttctcaaaggctgagcattacggcgtccgggtcgttacggctaaggggctggagaggtacctggagcggatcggcgtgccaaaggggtcgcgcctggaggcgctgcacggcattaagccagacgtccgcagggagtccagctggccactgcctcatgctgagggcctcctgaagccactcctgaccgtgacggagaagggcaggaaggggtacgctagcccatacacaccactgcgcaaggacctcctgaggtacctgaggggcgagaggcagctcacagctactgggtacgccatggtcctggagaaggctcaggatctcggcctggaggctgagccattccccttcaacgagtactacgttagggtggcctccgtggagccgggcggggagatcctcacgctggatctctctgtggagggcaatcatacatacctcgccaatgggctcgtctctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2995 - DNA, 2235 bp, Artificial Sequence
  Synthetic Construct, AT-152 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgtggggtctactcgcattccgacggagcgggggctggttcctattgaggagctcgctagggagggggggtctttctacctggtgactgacaacagggctccgttcggcgggaggggcgctccactcccaggccacgggaccgccgtcaggaaggccgttcgggcgttcttcacgggcgtcaagccagtggtccggctgaggacaagggagggcctggaggttaccctcacgccagatcatctcctgctcacgccagagggctacagggaggctgggaagctgaggccaggcgagaagatcctcgtccagtccggcgaggggctgttcccaaaggaggagagcctgcctgctcaggctctcgctgttgtgcacgagagggtggcgacggctggcgggaggggcgggaggggcagggctgacgtccgcgcccagtacaggaacctccccacacgctggtcaagggagctgggcgttgctctcgggtggctgctcggcgacgggtacctgagggaggatggcgtcgggttctacttctcccggaaggacttcgctgatctggcctggctcccagacctgctccgcgattggttcggccctgggacactccaggagactcgcagcaacaccttccacctgcatttcaataggatcccggctgagttcttccaggctctcggcgtgaaggctgcgcgggcaactgagaagagggtcccagagtcgctgttccgggctcctcgcgaggctgtcgttggcttcctgcaggggctcttctctgcggacggctcagttcagattaacgagaataagcaggatgctaccgtgaggctggcctccagctcgctcgctctgctccaggacgtgcagctgctcctgctcaacctgggcatcctcgggaagattcacaagaggagggaggctgctaggaaggctctcccggacggcaagggcgggctgagggagtacccagtcgctcctcagtacgagctgattctcggcggggagaatagggatcggttcgccgaggtggtcggcttcctccaggaggagaagcagagcaagctgctcgcgttcctgaggcataggccgaggggctcgtacaggaagcccttcctcgctaccgttgcttctgtggagccagctggcgaggcgcccgtgtacgatctcacagagccagttacacactcgctcattgctaatgggctcgttgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2996 - DNA, 1572 bp, Artificial Sequence
  Synthetic Construct, AT-153 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggagacgccagtctacctcgctgacggcaagacaattaagatcaaggacctctactcatctgagcgcaagaaggaggacaacatcgtcgaggctggctccggggaggagatcattcacctcaaggacccgatccagatctacagctacgttgatggcacgatcgtgcgctcccgctcccgcctcctgtacaaggggaagtccagctacctggtgcgcatcgagacaattggcgggcgctcagtgtccgtcactcccgtccataagctcttcgttctgaccgagaagggcatcgaggaggttatggcctcgaatctcaaagtgggggacatgattgctgctgtcgctgagagcgagtcggaggcccgggattgcggcatgagcgaggagtgcgtgatggaggcggaggtctacacctctctggaggctacgttcgaccgcgttaagtcaatcgcgtacgagaagggcgacttcgatgtgtacgatctgtcagttccagagtacggcaggaacttcattgggggggaggggctgctcgtgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2997 - DNA, 1470 bp, Artificial Sequence
  Synthetic Construct, AT-154 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcaggggagactgcggttatgacggtggagtacggggctattcctattcggcggctggttcaggagcggctgatctgccaggtttactcgctcgacccacagggccacctgtacacgcagcctatcgctcagtggcatttccagggcttccgcccggtgtacgcgtaccagctggaggacgggtccacaatttgcgctactccggatcaccggttcatgaccacgagcggccagatgctgcccatcgagcagattttccgcgaggggctggagctgtggcaggtggccatcgctccaccaggcgctctcgctcaggggctgaagccggccgtccagatgtcctgcatgaagattgtgggcaggaggctcgtcgggtggcaggctgtttacgatattgggctcgccggggatcataacttcctcctcgctaatggggctattgctgctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2998 - DNA, 1935 bp, Artificial Sequence
  Synthetic Construct, AT-155 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccgctgacacatgggttactaccgctgaggggccaaggcaggtggaggagctgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcggatttctgcgagggcatcctgagggggctcttcgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 2999 - DNA, 2382 bp, Artificial Sequence
  Synthetic Construct, AT-156 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggggactgaggtcatgatgcacgacggctctgtgaaggctattgagactatcgaggcgggggaggctgttatggggaccgacggccagccaaggaaggtggtcggcctccctcgggggagggaggtcatgtacaaggtttcccagaagacggcgcaccgggtgcataagaccgacgagacgcgcgccgctccagtcgctctcttcgagtacaactgcaatgccacacacaagctggttgtgaggactcctcggagctgccgctcgatcacccgcaagatgcagggcgttgactacaacgaggtcatcttcttcgacctcaagaagaagaagctggaggacggccgcgagatcgagattgtcaaggaggtttcgaggtcttacccagctgctgagggcgctgagaaggctgctcagatggtgaaggactactacgatgccgcgcgcgggaaggagttcttcgagtggacaatcgaggcgagggatgttagggagctcggcgctcacgtgaggaaggctactcatcaggtgtacgccccagtcctgtacgagagcgacttcttcttccattacgtgaagaactcgaagttcgctctgaggtctgaggcctcaacagctctcgcctacctcctgggcctgtgggtcggcgacgggctctccgatagggctgtgctgtccgtcgacagcgaggattccagcctcctggagcgcatcactggctacgccgacattctcgatctgagcgcggagtacaaggaccgcgagatcccgaagagggcgaagaccgtctgcctctaccccaagacgatccgcggcaacgatattcgcaggaacctgaatacggacaacccggtctggaatgccatcgttgacctcggctacctgaaggatggggttaagaatgtgccctcgtacctcttctcagactccatctgccacagggaggtgttcctcgcgggcctgattgactctgatgggcatgtccggggcgacgatgggctgtcagttacaatcaagactattcacaagaccgtcatggagggcacggtggctgtcgctaggtcgctcgggctgatcgtttctgtgaacaccgaggaggcgaagattgacaagaacgatgtgaatcaccgcttcgtctacgctatctacatttcaggcggggacgctctcctgtccgtgctcgctcattgcgctgctgcgaagaagttcagggctccaccatccaatgaggtcgttcgggggctcaagaaggtcttcttcgagatggaggagctgaaggaggacgattactacggcatcacgctcgctaaggagtcagaccatcagttcctgctcgccaatcagctcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3000 - DNA, 2364 bp, Artificial Sequence
  Synthetic Construct, AT-157 intein modified protein CDS1
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgccaagggcactgaggttatgatgtcggatgggtcaattaaggaggtggagggcattgaggtcgggcaggaggtcatgggcaaggacggcaagccgcgggaggtggtcggcaccccatcggggcgcgagaagatgtacaaggtctctcacaagaccgctcacagggcccataagtccgacagcacgtcggagcggttcggcctcttcgagtacacatgcaacgccactcataagctggttgtgcgcacctctaggtcatgccggccgctcgtcaggaacatccagggcacggactacgtcgaggtttgcctcttcaatatgaccaagaagacgctggaggacggccgcgtgatcgatattgtcgaggagaccagcgatttctacccagcggtggaggggcctgagaaggctctcaggatcctgaaggagtacgctgaggccgacggcgggaaggagtacttcgagtggacaattgaggctcgcgatgtggctctcctgagcgctcaggtcaggaaggctacttaccagctgtcggcccccgtgctcctggagaacaatcacttctctcattacctcaaggactccaacagcgctgttggcaatgatacagtgcgggccctgtcctacttcctcgggctgtggatcggcgacgggatgctcaacaatgccgcgacgttctcagtcgattcccagaacgcgagcctcctgaacaggattaatgagttcgccgaggtgctcggcctgtctgcggagtacaaggactcacaggagccaaagcgggccaagaccgttaacctgtacgcgaaggctatccgcgacgagggcgtgaggaagaacctcgatacgcacaatctcctgtgggacgcgatcgtcgatctcggctacctgaaggacgattcgaagaacgttcctgggtacatttgctcggactctttccagcatcgggaggtgttcctggcgggcatcattgacagcacaggctacgtgtccgatgagaccgccacggtgaagactatcgaccagtccgtcatgacaggcactgtggctgtcgctaggtccctcgggattaacgttagcgtggacgtcgaggttgacgaggatggcgtcgatcggtcattcgtttacgccatctacatggacaggtccgatgctctcctggctgtcctggctaactgcgcttccaacaataagcagatcgaggctccaccacacggcgtgattagggagttcaataaggcttacttcgagatggaggagctggaggaggacgagtactacgggctgactctctcaaatgagtcggatcatcagttcctcctcgctaatcagctcgtcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3001 - DNA, 4868 bp, Artificial Sequence
  Synthetic Construct, AS-1 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcatcgaggggacggaggttctcactaagcgggggttcgtggatttcagggagctgcgggaggatgatctggtcgctcagtacgacatcgagaccggcgagatttcctggacgaagccatacgcttacgtcgagcgggattacgagggctccatgtaccgcctgaagcaccctaagagcaactgggaggtggtcgctaccgagggccatgagttcatcgtgaggaatctgaagacggggaaggagcggaaggagccaatcgagaaggtcaagctccacccatactccgctattcctgttgctggcaggtacacaggggaggtggaggagtacgacctctgggagctggtctcgggcaaggggatcacactcaagactaggtctgccgttaagaacaagctgaccccgatcgagaagctcctgattgtgctccaggcggacggcacaattgattcaaagcgcaatggcaagttcactgggttccagcagctgaagttcttcttctccaagtacaggaagatcaacgagttcgagaagattctcaatgagtgcgcgccgtacggcatcaagtggaagaagtacgagcgccaggacgggattgcttacacagtttactaccccaacgatctgccgatcaagcccactaagttcttcgacgagtgggtgcgcctcgatgagatcacggaggagtggattagggagttcgtggaggagctggtcaagtgggacggccatatcccgaaggatcggaacaagaagaaggtctactactacagcaccaaggagaagcgcaataaggacttcgttcaggctctctgcgctctgggcgggatgaggacggttgtgtcgcgcgagaggaacccgaaggccaagaatcccgtctaccggatctggatctacctggaggacgattacatcaacacccagacgatggtgaaggaggagttctactacaagggcaaggtctactgcgtttctgttccaaagggcaacatcgtggttaggtacaaggattctgtctgcattgctggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3002 - DNA, 4289 bp, Artificial Sequence
  Synthetic Construct, AS-2 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgccagccttactctgcgccggtttcaactcctgatgggcctattcctatcggcaagctcgtggacgctaatgcggtcggggagaaggtgttcgacgcgtcgggcgtcaccaggattgttgctaccacgtgcaacgggaggaagccagtcctccgcatcaggacatccggcgggcacgttctcgacgtgactccagatcatctggtttggcaggtggtcgaccagaccgctggcaggttcgtgccagctggccagctccgggtcggggataggctggagtggcacgacagggccaattccgatgctatggtcgctgcgttcacggctgacagcgctgctgcggctcagccaggccagatcgttgacattctcgcgatcgatgagctgggcgtgatgcctgtctacgatattcagacagagtcgggggagtacctctcagatggcattagggttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3003 - DNA, 5084 bp, Artificial Sequence
  Synthetic Construct, AS-3 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacaggggacacaagggtcctcctcgcggacgggcagcgggttcctattcgggatctcgtggggcagacgcctgaggtcatttctgtcaacgctgagggcaggctggagccagctaagaccgacctcgtgtggtccgttggggtgcgccctctcctgcaggtcaggctggcttccggcaggaccatcaggtgcacgccagagcacaggctcaggggcctgtgggattggaaggaggcccgcgacatcagggtcggggataggctgggcattgctcgggagctcccagctccaaaggtgacgaagcgctgggctgagcacgagctggtgctcctggctcatctcgtcggcgacgggtcctacattaagggccagccactgaggtacaccacggcttcagaggcgaactccgaggctgttagcagggccgctgaggctatgggctctacagtgactaggcacccaggcagggggcagtggcatcagctcgtcatctcaggcaacgggaataggtggcacccacagggcgttgggaagtggctcaagcagctgggggtgttcggccagaggagccgggagaagcacctgccacaggaggtgttccagctcgacaatgatcagctggccctcttcctgaggcatctgtgggcgacagacggctcgatcactcaggggtctgctggccgccctaggatctacttctcgacggcctctcggcacctcatccaggatgtcgctgccctcctgctccggttcgggatcgttggccgcacaaagcacattactcatggcgacggggagggctggttcacactggatatttcgggcgctgtccagcagcagaggtacctggagaagatcggggccttcggccaccaggctcataacgctaggagggctctccagcatctgaggggcctcgtcgagaacaccaatgttgacacgctgccggaggaggtgttcaattacatccgggagcgcatgagggaggaggggattacacacaggcagatggctgctctcaggggcactgcttacggcgggagcgctcatttcaccttctccccgagcagggagacgctgctctcgtacgcggacatcctcaacgatcagcggctgcgcatgctcgccaatcagcacgttttctgggaccgcgtggtctccgtggagcccgcgggcgaggaggaggtcttcgatctcacagttccgggcaatgcttgctggctcgcggatggcatcgtttcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3004 - DNA, 5645 bp, Artificial Sequence
  Synthetic Construct, AS-4 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgccaatgggacacagctgctgcgctacgatgggacaaaggtcaacgtggaggacgtgaaggagggggatctgctgctgggcccagacggcgggccaaggagggcgttcaacgtggtctccggcaaggaccgcctgtacaggatcaagattgacggggataaggaggatctcgttgtgaccgccaaccacatcctcgtgctgcatagggcgaaggctatgaatacgtctgtctgcttcgaccggtcaaaggagcagcagggcggggctggcgagcagctggacatttccgaggtcagcgccgcggagcgctacgataccgttgagatgacggctgctgagttcgctgctctgcacccacaggagaggtcctggtacagggctatcaggtgcccaggcttcgagctccctgagcaggacgtcccagttaacccttacttcctcggcctgtggctcggggatgagtcccggaaccagagcgctatctactcgaatcacgaggaggccctgcgcgagttcctcgtgagccatgccgcggagctggacatgcacctcgtttaccatggccagtcggcgtactctaccgtgtgcaacaaggatcgcccaacgaataagaggatcggccctgccaaccagacccagacggtcaggccaaccatccggcagacacggcgcactattaggcagcagaggctggctgctgagcacgctgctgctgagtacaccacgcagagggagacagcgtccctcactccgctcctggagtcacccacatccgacaagcatggcctcctgtccagcgtcgagactccagggaggctgtcagattccgttacaactgagctccccatgagcaggtcggcctctgctatgaggtcgatcaggaccgccagcggcctctcggagttcaacgacgtgacgaatgtctcagcttccatgccggatatccagaactctggcattaagaatcaggggaggatcgctaaggtgaccaggcagcaggactctaagggcgaggtcgatttccgccagcagtactcacaggccattaaggacgatctggagctcctggagacggacatcgaggacgatgtggcgtcgtctgacgagattgaggatgtctgcgtcgttggcagcgagaacgagctcatcgggtccgagaagcaggaccagagcggcaggaggaggcagattcacaggctgaggaccgggcataggggctacggggacctctcggacgatgagcaggagcagctcctggacagcgtggtcgagcgctacgcgggcgattcgcggctgaatacactccagcaggagctgagcaagatgggcatcctcaacccagagactgggcctatcaatgacaagaagcgcattccgcaggtgttcatgcagaacagccggtcggttcgcctgtcggtgctcgctggcctcctggactctgatgggtggtacatctaccccgagaatatgttcggcttcgctcagtccgagctgtgccacaaggagctcttctgggacgttgtgacactggctaggagcctcggcttcggggtctggacaaagaagcggatgatgccggaccccactggcaagcgcatgtcaccaatgctggtggcccagatctccggcgatctggcggagattccttgcgtcctcgctcgcaagaaggccatgccgaggctgatcccccagtctcactcattcgccatcaaggacatttctctggagtcagaggcgacggagtgggctggcttcagggtggataaggatcagctctacctcaggcatgactacgtggttctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3005 - DNA, 5234 bp, Artificial Sequence
  Synthetic Construct, AS-5 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctgccaccatgggagcctatcgtggtcaggcggggggatgaggttcgggttacatcaatcggggagttcgtggattctttcctggagggcgagggcgggctggacatcggcgggctcggctactacaccctgtcgctcgatacccggacgctgaagccagtctggaggaggatccgcggcgttattaagcaccggatccgcggcaggctcctgagggtcaaggcctcaaagggccgctccatcgacctgacgggctctcattcaatctacaggattagcaggggcgggggcctggaggtggtcggctccagcgacctgaggccaggcgattctctcgtgacacctgcttcagtcgagctcccagagtccgccccttcgtctattaacgctgcgagggagctgtggagccggggggtggagggcatcttcgttgtggggctcccaggcgaggctgctgggtacaggggcgtcgagcggtcgcgcggctacgacgggggccacgctatccctctggagacgctcgtggagcgctacggcgattcggtctggtctctggtttcaggcgcgaagctcgctgtttcccggggggctgctggcgaccacccagtgcccgccaccattccgctggatacggggttctacctcctgctcggcttcatcgtgtccgctggcagcgtggacgtcgaggggggccatgttacagtgactctcggcccagggagggagggctacgtgggcgatgtcgttgaggctgtcaactccactgctccaggcgctggggtccgcatttcatccggggcgaggggcatggaggttaccatcaggagccgggtgctgtcggagctgctcgctagggtgttcggcgctgggccaggccctaatcgggacatcccctctattgtcttcagggccccgaagcccatgaagcgggttttcctgaagggcctctacgctgggggcggggtcttcgaccggagctcgggcagcctgatctacgccaccgattcccgcagcctgctcaacggcctcgctctgctcctgctcaatgtgggcgctggcgggtacaggatcgactcgggggattctggcagggctctggcgctcattgtggagaatgctggcaggctcgacgctatcggcgaggtcctggagcacctcggcttccatggcgggagggaggctgttcagggggtgggcgctctggagagggctacagctgggctcgctggccaggctactgtcgctgttcagaggccagctacccgcggcgggccaggcgtggacgtcgcgggggtgacgggcctggagcacctggaggctagcacagagttcgtctacgatctctctgtggagggggatgagaacttcttcgccgggctcgggtggattctcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3006 - DNA, 4964 bp, Artificial Sequence
  Synthetic Construct, AS-6 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctcctgagacactcgtgcataccgctgatgggcctcggcctattcgggatctccagcagggggatctcgttctgggcatcagcggccgctacagggaggttacccacaagttcgtgtacaaccagacggacgctatgctcgccatccgcgtcaagcacgccgttgagccaattgaggttacagctggccatcctttctacgccatcaggggcgtgccactggagcagtcgggggagcgcaccctcaggcagctggagtccggcaagcggagcccagagtggatcgacgctggcgagctggagaggggggattacatggcccaggtcatcccatctgaggtggtccctgtcgcgggcttcgacgaggacgatgctcgcctctacgggatcctcctgggcgatgggcatctcagcaagaatggcctgcagtggggcgtctcggggcacccacagagggacgggcacatggatttcgttagggcgtacctgtccgctcggggcatccacttctgggagaccgcgagggacgagacgtacgggcagattcattgggctagcggcaggggggtccgcagggatgctaccacgggcaggatcacaggcgctggggctgcgactctccctttcgagcacgccgacctgtacgatgagcagggccggaagcgcatcgctaggcgcttctcacatctcccaaggcagcagtccctcgctctgatcaggtcgctcctggagtctgacggcggggtgtctcgcggcaaggagatctacttcacaaacacttcaaggcccctcattgagggcctgaggtaccagctcctgaggctgggcgtgccaaccgctgggcagtacagggagaggaggcaggaccacgtcggccagagggctgatgggtcgccaatcaggttcgagggcgtgtgcaaggcgtacgacctcaggattccggctgttccagaggtggctcagctggtcggctgccagccaatcgccaagcggaattggattacgtggcagggctgcgtctactccaggatccgggatgttcagccgattgcggtgaagcccttcgtcttcgatctcaaggtggagggggatgagagctacatgactacttccgggctcgctcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3007 - DNA, 5294 bp, Artificial Sequence
  Synthetic Construct, AS-7 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctctcgggggatactgaggtcgttctcgggaatggcatggacgtggttctgctgacggatctcgtggacggggcgtgcgtttcgacaatcgagccaaggactggcgtggtcagcccatcgctcatcgaccattacttcgccaaggatgcgacccgcgtcctcaagatcacgctggacgatggcagggttattaaggctgacccagagcaccctctgttcgctgctaaggtggatgagaccacgcgcggcctcaccgggcagtggctgagggtggaggagctcacggtcggccaccatgctctcctggtgtcgccacagcaggcttactgcacctctgagcagtggacactcactctgtcagagaaggaggtctgcaccgcttccacggctcagctcgctaagcagctgtccgagatcggcctggtcggggttccgattcccctctctaaggtgaagtcagctgccaggctgttcggcctcgtcctgtccgctggcgacttcagcgggaagctctacgtggagaaggacgaggatgttacagccgtgaacagcgacctcactgcgctgggcttctcgccagctcactgggtccggtaccaggacgatcagcagaagtggttcaagtgcgacgattcgaacggcaaggcgatctgcattaccctggtccctacggctaatgctctcctgcagaccctcggggctcacgacgctgagaagcagcatcggtactgcctcctgccaaagtggctcctggatgcccctacgtccatcaagagggagttcctcggcgctctgttcggcgggaacggggcccacatcacaatttcgtgcaatgagggcaagtgggagccgactatgtctgcgctcacacagcacactgacgctgatcatctggagagcacagttgtgtacctcaagcaggttgccactctcctgggcatgctgaacatctgctccagcgtgtcgtctgagaagcacattacagccgagaagactgggtacgcggtccacctgcatgttgacaacacggcggagaatctcgttcggttctacgagcaagtgggctaccgctactgcttcaataagacatcccagtcatccgcccccgtgcagtggatcaaggggtctctgttcttcattgagcagcaccgctcaaagtgccagcatgctttcgagctcctgcacaccggcctcgggacgaaggctgctgtctccgccgagatcaacatgccacaccataatcctagccacatgctgaacgttaaggagatcccgaccgctcccgccgacgagtacatcacgtggattgagttcaaggatcgctacgtgcataaggagtccccgcggttcgtgtgggtcaccatccacagcattgaggaggcgcccgctgagaggctctacgacttcaatacggtttcgcagaatcatagcttcttcgccaacagcatcgtctctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3008 - DNA, 5087 bp, Artificial Sequence
  Synthetic Construct, AS-8 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgggcgggatacccctctcctcatggcggacggcactactaagttcgttcaggacattaaggctctggatcagctcatgggcgacgattgcacgccgcgcatcgtccaggagaggtctctcgttcacgagtcaggggctctgtacagggtggtccccaagaacgccaatggccacgacgcgttcgtgtgcaacaaggagcatatcctcgtgatggtcaatgttaagcagccgtgggtcagccagacggttatcgacggcgtggatcagttccatgtctcggaggttgtgtgcatcgggaacattccgacagtgcgctccagcggcaatttcgcttctgctgtcgaggctacgaaggctctgccagcttggacactcctgatctgggagattagcgtgctggagtacctggcggtcgacgctgatctcaggcagcacttcatgatctacaagccagctggcgggattgagtacccaaccacgacaaacctggacatcgtgcagcacttcggcgccgagtcggttcccaacctggagcatgccgtgatgtggtgcatcggcctgtggattctcctgggggacgtcgatacagccggcaacccagttctcatcctgagcggcattgaccacctccatcctctgatcaagactctccactcgcattctcagaagctgtcaatttccttcaccaaccagctcgacgagggggtcgctgatatcagcaagccaaccatcattgccctcggcgacaagttcgggctcctgttcaagtccctgggcatcgagagcgctgagtgcattcctgatgccctcctgaggtcgtctaagctccacagggctgctctcctggctggcctggtggaggggagcaacgctttctcgatcgtcaaggacactccaaagcattgggatatttcctgcaagaacaatatgatcttcgagaatattaagaggctctcatccagcctcggcctgtgcgttgacacggtgacaccagcgactatcacccagcaggtgtccgtcaagacgctgcagatccggatttcgggccctcgcatgcactacgtgtctgagctcatcagcaacgactcgctgaagactacctctgtcgtttcaatcgattcctggctgaacgtcaagtcaaatgcctgcgagttcgagatcgagtccattggctgcggggagtacttcggcttcacagttatggggccaaactcaaggttcctcctcggggatttcacagtcacacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3009 - DNA, 4985 bp, Artificial Sequence
  Synthetic Construct, AS-9 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacgggggagacgctgctgctgacggagaatggctacgagaaggccgctgatctctacaagaagcagaacaatctgaaggttgtgatcgacaacaggacaaaggacttcgctgtggatagcaagggcaccacgatcgtcgacgctattccaatgcagctgacgaagaaggatgccgagatcttcaaggtcaagaccaagcagggctacgagattcgcgcgacggagtggcacaagttctacgttaagagggacggcgagatccagaagctgcagctcaaccagctgaagaccggggataagctcctggtccagtccgctgagggcgcttacgggaagatccatgagcccgacctcgcctacattatgggcatcattgcgggcgatgggaccatcacggagaagaccgccaagatctacctctacgacaacaagaaggtgctggagcagaaggttacggatgcggtgcacaggatcattcacaagcataaggtcgaccgggcttacaagcataatacatcactcctgccaactttcaacatggcgaatcctgagaagcaggacctcctgtacatgaactccacagttctgttcgatatcctcaagaagttcggcatgaataaggagcgcaagactagggtcccggagttcattttccaggccaacaaggagacacaggccgcgtacctgagcggcctcttccagactgacgggtgcgtgaacgcgaatcacaaggctaaggccctgaccatcgagctcacgtccattcattacgagagcctgcaggatgttcagaagctcctgctcaatatgggcgtgtacacaactatctactcgaacaataagcggtctcaggagctgctcccagacgggaagggcgggtcgaagctctacaacgtcaagcccacccacaagatctcaattcaggatcgcaactcccgcgagctgttcatgagcatcgtcgagctcaaggactacgatgtttacaagttcaacctgctcacagagactctccagccgaagtcgcgcaagcccaagcacgacttcacggccgagatcatttctatcgaggaggacggcgtggaggatgtctacgatactactcaggaggattaccactctctcatcttcaatggcatcgttacgggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3010 - DNA, 4940 bp, Artificial Sequence
  Synthetic Construct, AS-10 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttaccgctgacacactcatcgctactgacagggggctggagaggatcggcaacatcgtgggggagtctaggggcatcaagtctattgacggcaagctccactgggtcgagaacatcttcccgacagggactaagcccgtttaccagctgaggaccaagtctggctaccagctgaagctcaccggggatcatgtggtcttcacggagaataggggcgacgtcaaggcttgcgagctgaggaaggacgatatggtccggctcgttggcgctccattcgggaaggagaccacgggctccacagatatcgcccagctcattgggctcctgactggcgacgggtgcatcacaactgccaacgagattgctgcttcgggcgagcagaggaggaccgcgttcctgacggtttctaaggctgagcaggagattgcggagtgggctaaccagttcatcaatacgctgaggccggagctcggcgagcacaataagtcggggtctgtgaccgagacggccaccacggcgcgggttgctgtgggctccccacgcatcctcaagcagttcgaggcgttcgctgttctggataagggcagcgtgcataagctcttcacagacaaggtgttccagctggctcagtcggagcaggctgctctcctgaggggcctgttcacagctgacgggactgtcgccaactactccgataagtcccagtacatcgctctggacgctacgagcctggagctcctgcagcaggtccagctcctgctcttcaacttcggcatcaagtccaagatctacgagaataggagggtgggcgagctcgtctccctgctcccagacgggaagggcgggatcaaggagtaccctgtgcagcagatgcacagcctcaggatctcgcggtccagccgcattctgttcgagcagcagatcggcttcatggccgagtcgaagaagtacgaggccctggcggagctcaaccgcacagtgtccacttacagggacagcgcgtacgatgctgtcgcctctctgacctactcaggcgaggaggccgttttcgatctcacggagccggagacggatcatttcattgctaatggcattggggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3011 - DNA, 4658 bp, Artificial Sequence
  Synthetic Construct, AS-11 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctccatggggattcgctcatcgtgacagatcatgggctcgttcctatgcgggaggtcgtgaatcatcgccagcggctgcaggtctcagacggcgagaggcagcagacagtgtacgactggaaccggttcgccgattacccaaccgtcacgatgaggaccagggcgggcttcacactgactgggtcccacaatcatcgcatcatgctcgctgacggcacctggaggaggctggacgagctccagatcggggatcgggtgcgcattgctggcgggaccgagctgtgggctacggagccagctctcctgaggtgcaggaggccgctgcccagggtcctcgttaccgctggcgccccggccgcgaccacgtccagcccccacaggcgggggtacaggagggctgctgctgtggtcgttgacgagaagctcgctgctgctatcggcaggcgctgcgttacgcatgctgaccagcaggccctggatgcgattaggaggtcgccaaggcctcaggtggtcgcgttcctccgcgctttctgccagggcgctgggcagtcggtcgcttctggcctgaccctcacgtgcgctgacgctgatctggccacaactgtgcagctcctgctcacaaacctgggcgtcctcgcgcacaggactgacaccacggttcggattgataatggcgacgatctggagagggcttacacaactctcgccacaccgactggctggaccgacgaggttgtggcgctggagcatgggacggctgatgtctacgacatttctgttactgctactcatcgctacgctgctcagggcttcatcaaccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3012 - DNA, 4268 bp, Artificial Sequence
  Synthetic Construct, AS-12 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtgacaggggacactctcatctgcctcgctgacgggcgccgcgttcctattcaggatctcgtggggcattcgccggaggttattgcggtcgacgataagggccgcctcgtttgcgctaagtcagaggtcatctggaaggtcggcgagcggtccgttttcgagatcaagctggcttccgggaggagcattaaggctaccgctgagcacaggctcctggcgttcaagggctggaggcatgttaaggacttcaaagtgggggataggctcgctattgctcaccaggtcccagagccagacaggctcctgcagcattgccagtcggacctgttctgggataggatcgtgtcgattgaggagaaggggtctgaggaggtctacgatctcacagttccaaagtacgcttcttggctcgcggatggggttgtttcacataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3013 - DNA, 5198 bp, Artificial Sequence
  Synthetic Construct, AS-13 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacatcggaccatacggttctcactacaaggggctggattcctatcgctgacgttactctggatgacaaggtcgctgttctcgacaacaatacgggcgagatgtcctaccagaacccacagaaggtccacaagtacgactacgagggccctatgtacgaggttaagactgccggggtcgatctgttcgttaccccaaaccataggatgtatgtgaataccacgaacaatacaactaaccagaattacaacctcgttgaggcttccagcatcttcggcaagaaggtgcggtacaagaacgacgcgatctggaataagaccgattaccagttcattctcccggagacagccactctgaccgggcacacgaacaagatctcgtctacaccggcgattcagcccgagatgaacgcttggctcacgttcttcggcctgtggatcgcgaacgggcataccacgaagattgccgagaagacagcggagaacaatcagcagaagcagcgctacaaggtcatcctgacgcaggtgaaggaggacgtctgcgatatcattgagcagacactcaacaagctgggcttcaatttcatcaggtccgggaaggactacacgattgagaacaagcagctctggagctacctgaatccgttcgacaacggcgccctcaataagtacctgcccgattgggtctgggagctctcatcccagcagtgcaagatcctcctgaacagcctctgcctgggcaattgcctgttcactaagaacgacgataccctccactacttctccaccagcgagaggttcgctaacgacgtgtcgcgcctcgctctgcatgctggcacaacttctactatccagctggaggccgcgccatcaaacctgtacgataccatcattgggctccctgttgaagtgaataccacgctgtggcgggtcatcattaaccagagctcgttctactcgtactctactgacaagtcttcagccctcaacctgagcaacaatgttgcgtgctacgtgaacgcgcagagcgctctcacactggagcagaactcgcagaagatcaataagaacactctcgtcctgaccaagaacaatgttaagtcacagacgatgcactcccagagggctgagagggtggacacggctctcctgacacagaaggagctcgataattcgctgaaccatgagatcctgattaataagaacccgggcacctctcagctggagtgcgtggtcaatcccgaggtcaacaatacgtccacaaacgataggttcgtgtactacaaggggccggtctactgcctcactgggcctaacaatgttttctacgttcagaggaatggcaaggctgtttggactggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3014 - DNA, 4865 bp, Artificial Sequence
  Synthetic Construct, AS-14 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacgggggacactctcgttttcactgacaaggggctgattgaggctcgcaagctggaggtcggcatgaaggtctggtcgggggacggctggaacgagatcaaggaggtcattaacaatggggtgaagccggtcctgaagctcaagctgaagaccggcctggagatcaaggttacggaggagcacaagatcttcacaggcgaggggtggaaggaggccaaggacctcaaggttggcgataagctctacctgccggtgtcttaccccgagctggacttccccgtcaaggaggagaacgatttctacgagttcctcggctacttcctgggcgacgggtcactctccgttagcaaccacgtgtccctgcatgtcgggaatgacaaggagctcgcgctgtacttcaaggagaaggttgagaagtacgctggcgctgcttacctgatcgagagggacgggcagtacatcattgatgtgcatcgcaaggagttcgccgagaagatcaagaagattttcggcatcgagattaccgactcgaaggagaaggatatcccgtccagcctcctggcggtgaactccgaggctatgaaggctctcctgaggggcctcttctcggctgacgggtctgtctacgatgctaatggctctatcacagttgccctgtcgtctacttcatacccactcctgcggaaggtccagatcctcctgctctcactcggcattccttccacactgactggggagaaggaccaggatgtgaagatcattaagggcaacgagtacgagaccctcccaacgtaccgcctgatcattagcggggagagggcctcgctcttcttcaataagatcggcctgattggggagaagaagaagaagttcctggagctgatggcgggcaagaccacgtactccaccctcaacaatcacctgtaccaggagatcgtgagcattgagcccgctggcgaggaggaggtcttcgatattacagctccaccaaagtacacttggattaccaatggcattctctctctggattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3015 - DNA, 4235 bp, Artificial Sequence
  Synthetic Construct, AS-15 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgtggcgggcactatgatcctgacagtcgcggggctggtcgctattgagaatattaaggcgggggacaaggtcatcgctactaacccggagacattcgaggtggctgagaagaccgtcctggagacctacgtgcgcgagaccacggagctcctgcacctgacgatcaatggcgacgtcattaagacaactttcgagcatctcttctacgccaaggatgtcgggttcgttgaggcgaaggagctgcaggtcggcgacaagctcctggattccaaggggaacgtgctcgtggtcgaggacaagaagatcaagattaccgatgagcccgttaaggtgtacaatttccaggttgatgacttccacacataccacgttgggtgcaatggggttctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3016 - DNA, 4829 bp, Artificial Sequence
  Synthetic Construct, AS-16 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctcagctggctctggacactcctattcctacgcctgacgggtggacaactatgggggagatcaaggcgggggacaaggttatcgatgagaagggcaggccgtgcaatgtggtcgctatctccgagattgacgatacagagcaggcctacaagatcaacttccgggacggcactagcattgtcgccggggagcgccacctctggaaggttcaggtgaccaacaatggcaggagggagaagctcctgaccacgggggagatgtaccagaagcagttcaagaccaagtcgaaggagaatcgcgcgctcttcaggatcccaattgccgacgcgttcatcctccctgagaacaagctgccgattgatccctacctgttcggctactggatcggcaacgggaatgctgtgaagccggagatcacagtcatgcgcgacgatgtcgacgaggttatcaagaacattccctacaagctccataataggtacaagcaggagggcaactcagacatcctggtttacaaggagctcaagtccattctggtgaagaacttcagggagaagcggatcccaattgagtacctcagggcttctgctcagcagcggaagcgcctcctgcagggcctgatcgactcagatgggtgcgtctccacagccaagagccaggcgatctacgttactattctcttcgagctggccaaggacgtgcaggatctcctgtggagcctcggcatcaagaacacactgaagactgctccatcggctcgctacggcatcgagaccggggagatctgctacctcattaagttcacggcgttcaatgacctggaggtgagcggcctcgataggaagctgaagagggggcgggagcgcaacatcaagacccggtcgcacttccattacatcaagtctattgagaagaccggcaagacgaagatgcgctgcatccaggttgattctccaagcaggctctacctcgctggcaagtctatgattccaacacataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3017 - DNA, 4838 bp, Artificial Sequence
  Synthetic Construct, AS-17 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggcgggggacactaagattctcacatcatcgggctaccatcccatcaaggacatggagggcaagcaggttcgggtttggaatggctacgagttctcggagacaatcgttcacaagactggggtgaaccagaagctcattatggtgtctctggacgatggcaccgagctcaggtgcacgccgtaccataagttctacatcgagaccgggtcgcggccagctgacaagtctcgggtcatggaggttcgcgctggcgacctggagaagggggaccgcatcattaggttcgagctgccgacaatcactgtcggcgagaccacgatgagcgacaaggaggcctacacaaagggcttcttctctgcggatgggtgcgtcattaagtcaaagtacggcgaggatgagtacaggatctcggttaagcgggaggacaagattgaggctctgacgaagtatgtggatgtgatcaagtcccacacaaaccggttccgcactcatttctacgtgccagactacgtccagaataagttcgaggtccctatcaactcaatggttaatgagaagatttcctggctcgccggcttcatggacggcgatgggtgcgttatccgctacaaggacattgagaacatgcaggcggtgtccatcaataagagcttcctgcaggatattaggctcatgctgcagaccatcggcattcactccacgatcaacaagttcatgccgaatcgcgtgatgaagatgcccgatggcaggggcgggaccgacatgtacaacggggctgagagctggaggctccagatcgactcggagggcgtccgcaagctcttcgctctggggttcacgccgcgcaggctgaagatgaacggctccaggaagcggcaccataagaccaataagttcacgcgcgtggtcagcgtgacagaccatggcgatgtcgaggacacttactgcttcaatgagccaaagaggcacatgggggtcttcaacggggtcattacggggcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3018 - DNA, 5012 bp, Artificial Sequence
  Synthetic Construct, AS-18 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgatggcaagacaaagattctcacaaatcaggggttcatgacgctgcggcaggtttacgagcagggctacgaggggctctcaacgctgtcactcaacaccaagacgcacaagatcgagtggaagccaattctggacaccatgaagcgccagtccgagatgatcgatatttccgttagccagactggcaggatcaccgacaacacgctgcggctcacccctgatcataagatggtcaatctcaggggcgggaagtacacaaagactgagatccaggacctcctgaagcagcaggagatgctgactgtggcccagaccatcccgagcctcggcaacaataagcaccaggaggcggacctggcttacttcctcggcgggatcattacggatggctcgatctacacatccagcactcggggggaggtccagttcatccagaaggacgttccggagaagcaggctttcatttcgaagatgaacgatctggccaattcgctctacggcaagtctttcacggcgcacatcaagcccgtgtcgtcttcatacattaggggccagaaggtcacggggcaggctacagcgtacaggctgcattccaaggctatcgcctacgacgtcaaggagcgcgagaacaatattacacagctcctgctggagaacgaggctgagctgtcttaccatttcctcggcggcgtgatcgacggcgatgggtgctaccacaagaacaggctccatatctacatttcagaggagaatctgctccaggccgtcatcattgcgtgcctgaagatgaatactgtgccgcaggtcaccaagaaccggaatatctaccacctccagattgtggagaagctggaggtcatcctccggtacacccagcgcgtcaagggcgaggttacccccaggacgatccagacacggttcttcgcgacgcgccagctgttcgagaaccaggagacaggccagatcaagctccggcaggacaacaattgcctgatttctgataagcagctccgcgagatgggcgagttcgaggagctgatcgacggggatactcgcatgcagagggttattcaagtgggcgagaagagcgacggggatgtttacaacatcaccgtggcggagcatcataactacgtcgttttcacagccaagtacacaccagtcgtcgtttgcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3019 - DNA, 4871 bp, Artificial Sequence
  Synthetic Construct, AS-19 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtcgcgccggagacaaagatcctcacagacagggggcagatcgccatcgctgacgtcgcgggggagaaggtcaatatttggaacgggtcggagtggtctgaggttctcgtgaagaagacaggcgagaaccagccgctcctgaaggtgcacttctcaaatggcgagtccctggactgcacttactaccacaagttccatgtccaggagaactacaaggggaaggtcaagatcgttgaggctaaggacctccaggagggcgataagctgattaagtaccggctcccactggtggagtccgagaatgacatcgatttcccttacgcctacaccagcggcttcttctcgggcgacgggtctcatgatggcatggggaagccggagattgacctctacggcgagaagaaggagctcctgcccttcgtcacggttaggaacaagtactacggcgggtcatacggcgacaagtcctggcgcatcgagagggatgaggtggccgtctacgacgatgttaaccaggaccggatcgtgtgcaagctcccgctggatattcccgcgaagttcacagttcccgtgaatggctacactatccagagcaggctggagtggctggctggcctcctggacgcggatgggacagtcgctaggaacggcgacaatgagagcctgcaggttgcgtcgacccaccagcagttcctcctggacatccgcctcatgctgcagacgctcggcgtcgactctaaggtggtcaagatggatgagatggggtacaggtcgctgccagacggcaagggcgggtaccaggattacttctgccaggcgaagtaccgcctcctgatttccagcaacggcctcttccagctgggcgagctcgggctgaagaccaacaggctccagtggaatctgagggagcctcagagggaggcttcccagttcatcagggtggagaaggtcgagctcacctgccggtacgacgatacgtactgcttctcagagccaaagaggcatctcggcatgttcaatggcatcctcacagggcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3020 - DNA, 5651 bp, Artificial Sequence
  Synthetic Construct, AS-20 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgcttcggacactctcgttcgcacatcggagggggacaagccagtcgctgaggtcgctatcggggactacctgctggacgctgaggacaagccagtcctctgcatgggcgctaacccttcccagaccgggcgcatgaaggagatcgcttaccaggacttcgattcgaagaagagggtgtctttcaagtgcacaccggaccaccacctggagctgacactcactgattccactccctccctcagcggcaagtcagtcacctggttctccaggtgcacgggggctcacctcagcgaggaggtgtcggaggtctacctggacaacatggtttcgatcttctacaatgatctggttgactcgacggattctgcggtggacaaggattccattcacgaggccgtggacctggcgctggaggatcactaccataggggcaactctgaccagtactcaatccatctcaatgagtacatcagccggattgccgataaggagctgcagaacgagccggagttcatccgggagtgcattcacgacgccgcgaatcgcttcgtcatcacctccagcggcaacaggaatattaagtcggagtctttcgacgataagctcctgctctcacgctccaggtcgtctacagctgacagcgattcggactacgtgatcactgacgcctccgtccactctcattcaaacaattcatccgtctacctcgcctcaccagactccatgatccctgatggcgctgccaaccgcttcgagaatattgcgtccaagctgaaggagccagtgtgcaactgcggcgggatccggaagattttccgcagcttcggcaccacggaggacgctgagctcgcttactccctgctcctgagcgagcactactacaggctggacccacggttcgtcacagatggctacactttccaggcctcggttgagcagtacgagaacatgtgctctcaggaggtgcagaatatgcacctgaagctctaccgctcacctctcaagttcgtggagagggagcataactccgctgagctgccagtcgacccatacttcctgggcctctggctgggcgatggggacagctcggggacaactatcatgaccacggatcgggagattgtggtctggctcaactcctacgtcgagcgcctgaaccagaataagccggagggctgcttccccctcaagctgaccgagcagctgatctacggcgctgggcacacgtccaagagcgggcatacaactaaggtcgacgttaggaattacaagatctcttcaggcgatgctttcgtgcggtcggggacatactggaacccgattttcgacggcctcaagaagctggggctcctgaacaataagagcgctggcatcccccaggagtacatgaactctgacgagcagaataggctctcagttattgccggcctgatggattccgacgggtgctacgtgaagagccacaacacctaccgcttcacccagctcacggaggaccataagaagatcgtctacgatctgaaggagctcgccctgagctgcggcattaacaccacgggggtcgagctctcggttaagccgctgggcttcaataagcacaagcattctaccgagtatgtggtgtacctcggcaacgggagccagaagttccaggagctcctgctcctgccacggaagaagatggagatcagcaagaagcacgtgtcgctggacgcgcgccctttcacggttagcgacgtggaggatggcgagttccgggctattgaggtttcagggggggttttccagctcgctaataggctcgtggttgctaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3021 - DNA, 4712 bp, Artificial Sequence
  Synthetic Construct, AS-21 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgccagccatacgacgctctcgtttcaacgccatcggggctcgttcctatcggggctctcgtggagacagacgcggtcggcatgaaggtgttcgatgcgcacggcctcacacaggtcattgctactaagagcaacggggttaaggacgtgctgaggatctggacccgcgcgggccacgctctcgacgtcacggccgatcatctggtttggaggtccacaagcgctggcgctggggctttcgtgccagctggcgctctcagggctggggacacactggagtggcataggactattgctccaggcgagggggagatcacgagccgcgagattgctgaggctgctctcgctggcaggctgcaggctgatggcttcgtcgggcgctacgctgggaccaatgcttcgctcacgatcgaggcgatgaccgttccaacgaggctctacgacgctccactgccagtggtcgctgcctacctcaggtcactgttccaggctgatggctacgtctcgcgcagggagaggtctaccctcatcggcctggacatgatttccgaggggctgatcaggggcgttcaggggctcctggctaggttcggcatcttcgccagggtgcggagggaggctgatccacgccctgacaggcacgatctctggtccctgggcattcagaacgctggggacaggcggaccttcgccgatgagatcggcttcctcgacccagtgaaggcggctaagctggaggcttccttcgaccagccaggccaggctgctaagcctgtcaagaggctccagatcgagaggattgagccgaggggcccgatgcccgtctacgacattcagacagattccggggagtacctctctgctgggctcagggttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3022 - DNA, 5168 bp, Artificial Sequence
  Synthetic Construct, AS-22 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggtcgcgggcactgaggtcacagacgctgagacaggggcggtcgttacggtcggggagctcttcgagtcgcggagggcggtcacagtccacgctctcggcgctgacagcaagctgaggccaaggcctgttactgatgtggtctggaacgggcgcaagagggtgtaccgcctcaccacggagctgggcaagtcgatcacagccactgacaaccatcctttccgcgtgctggatggctggaagaatctcggggagctgaagccaggcgacaggatcgctgctccaaggaggctggcggtcccttcggctggcacctggccgcagcacgagattgttgcgctcgctgggctcctgtctgagggcaacacgtgccatcccacaactctctacttctacgggaatgaccgggttctgatcgacgatttcgcgcgggcaattggccagttccccgatacagtcgccaaggtttacgctaggccaaacaggaggaacctggaggtgcgcgctaacacaggcagggacactcgcctgaagtcaagggcggagagggatgctgctgtggctctcctggctccaccaacgaggtccggcgctttcgtctgggctcagaggctcggcatcctggggaagaccgctacggagaagttcgtgcctcacgacgtcttccggctctgcgacagcgatctggagctcttcctgggcaggctgtgggctggcgacgggttcattgctaatgataccctcaaggtcccgttctacgctacgtccagcaggaggctcgctcaggacgtgcagcacctcctgctcaggctgggcatcgtcgggaggattcatgagaagcagttcaagtacaagggcgggctcaagcccggcttcacagtgcacctgatcggcgacggggctgctgaggccttcctcgataggattgctccacactgcctggggagggagcatgctgtcactatcctcagggagcatgttgctaccacggcgaggggcctcacctccaaggacacggttccgctggaggtgcgcgcttgggtcgacgatgggaggagggcgaggggcctcacctgggacgagctggagcagcagtcggatgtctctacacaggagttctacggcactccagctccaggcaagaaggggttccggagggctacgatcgctaagctcgctgcgttcttcggctcacagaggctggctgctgttgctgactccgatgtgttctgggacagggttgtgagcattgagtacgcgggcgtgcaggatacctacgatctcacagtggatgaggatcataatttcgttgctaatgggctcatcgttcacaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3023 - DNA, 4691 bp, Artificial Sequence
  Synthetic Construct, AS-23 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgccagcctgcggggacacaggtcgctaaggttattaaggaggggaggtggagggaggattcggttattgagcaggttcctattgagtcactccagccaggcgacagggtggtctccttcgggaacgcgaagatctaccgcaggggccgcgctgtgacagggattacttcccggcgccacacaggcaatctgcatagggtcgaggttggggagttccgcaccagggccacgccagagcacaggttcaccgtccggttcgacccagctaggcctaaggctggcctcctgtacctcatgaggaggggcgataggtggagggtgggcgtctgcgggatgttcaactcgcgcggcttcggggtttccgtgcggctgagccaggagaggggcgacgctgcttgggtgctcggggccttcgcgacactgactgaggctaggatcgccgagcaggttgtgagctgccggtacggcattccaaccacggtctgggagaccggcaggaatcctggggcttcgtgggctcagagggaccaggctggcatcgatgccatctaccagaggctcggcgtcgataggatccgggctggggttgacaggctcctgagggatcacggcctctctgctgggctgccactcctggctgccaacgagcccggcaatttctcgtgcaggcagtctaggcaggtggctgcttgcaacctggtgccaggcgtcatgcaggtcccagttccaacggctggcgagaggttcgagtggagggacctcaccgctacgagcttcgagagggttcatgatctggaggtgtggagcatggatgtggagagggataagcattacgttgcggatggcatcgttgtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3024 - DNA, 5066 bp, Artificial Sequence
  Synthetic Construct, AS-24 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctgcggggacgctgctgcatactgagcagggctacgttccggtggagcaggtcgtggcgggggtcgggacaagggtttgcacacaccagggcttccggaacatctctgagcgcttcgataatggggaggccgaggttttcagggtgaccacgcggaagggctactccgtggaggtcactgcgaaccacaagatggctcgcctcgacgagaatggcgatctcctgctcgacgagctctcacatctgcaagtgggcgacaacctgctcctgctcctggggtccaatccggtgaccgagaaggtccggctgcagtgcatcccagctggctaccgctccagcatcgagattgctcagccgcccgagctcgatgagcagctggcttacctcctgggctacgcctacggcgacgggtgcgtcggcaggggggctacatacaactacctcagcctggctgtgtcgcacacttacccgaatgtccgcgaccagctcgccgcgatcattagggagaagttcggcctgacaactaagatctactcaggctccggggcggtttggaacctcctggtgcattccgccaatctcctggattggctcaaggcgaacggcctcctgaagcagaaggctgcggacctcgccatgccagaggcgattctgcgctcgccttcgtctgtggtcggcgctttcctgtctgggtacttcgacgctgatggctgcgtgaggggcgggaagggcgggtacgggttcgattgcacgagcaaggctttcgtcggcgctgttcagctcctgctcctggccgaggggatcgtgtccaacctccacaccacggaccggagccgccagggctggcgcacaatctacaggctcaatgtctgcggcaccgagttcaagcgcaggttccagacgctgtgctgcaggtctgcgaaggttgtgcattcaccaatggtgctcggcagggatgggaccggcgggtacccacctgctctggttaggggcgcttcgtaccagagggtcgttgctgtcggcgggaagcacctcctgtacacggcgctcctgaaggtcatcgagaagacaaggactgctggcaagcaggctctcgctgagagcctgtgccagcatgtcaactacttcccggaccccatcgtcgcgattgagtcggttggcacgcagagggtttacgatattgaggtggagggcatgcatctgctcggcaatggcatctacacaagcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3025 - DNA, 5306 bp, Artificial Sequence
  Synthetic Construct, AS-25 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgcctacgacgcggagatcgttcaggctgacgggggggttaagactattgagcagatcgttagggagcggcgggcgcatctcgctacggtcggcgctgactggaggctgacatggactgagccgtgcgattacgttgacgatggccacaagcccgtcttcgaggttaccacgcgcctcgggcgcaggatcgagacaactctgacacacccgttcctcactgtccatggctggcagaggctggaggacctcgctgagggcgatgctatcggggtcccaaggcagctgccagttttcggccaggagcccattagggactgcgaggtgaggctcctgggccacctgatcggggatggcgggctcaccggctcgccacccaggctgacgtctgggcaggaggcgatgacagctgacttcctggaggctgtggatgctttcggcggggtcgaggctaagccaatcagggcgtcccggaggacgcagagctgggtggtcgttggcgctgctcaggcccgcgctgctgctaggtccagcttcgcttcactggtcgacgccctcattaggaggtcccctctcaccggcagggctatcgctaggaacctgggggtggcgccagctaccctcacgtactggaggcagggcgtgaatgtccctgacgctgctatggttgggctcctggctggcgagctgggggttgatgtgggcgagctcaggccagagcctgtggctcgcaggaacgaccgcaatccactgcaggcttggctcgataggctgggcctcgctgggaagtccgctcacgagaagactgtgccagactgcgtcttccggctgcctcgcgagcagctcgctaggttcctgaaccggctcttctcgtctgacgggtgggtgacacatctggctagcggccaggggcagattggctacaccacggtctcggaggctctcgctaggcagatccagcacctcctgctccggttcggcgttctggctaagctcaggcataggtccgtgcgctaccaggacggcaggaggccagcctggcagctggatattactcacgcggagagcatcctcaccttcgctgagcagatcggcattctggggaaggagcagcggctcgcctctgttgctgcttcagtgcgcggcaggaggaggcagtcgcacacggaccatatcccctgcgagatttggcagttcatcgatagggccaggggcgagtggacatgggctgagctggctaggagggctggggtcgcttcatccaatatccacgcctacaggaggggcatgtctaggcagaggctggctgctttcgctgacgctctcggctcaagggagctgaggcagctcgcgagctcggacctgtactgggatcggatcgcctccattcgcccgctcggccataagcaggtgtacgatctcactattccagagactcataacttcattgctaatgatgtttgcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3026 - DNA, 5261 bp, Artificial Sequence
  Synthetic Construct, AS-26 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtgcatggggatacaagggttactctcgctgatgggcatgagcggcctattcgggaggtcgtggagtcaaatctggatgatccgaagccagtcgacgatggggtttgggataccgtggacttcgatgtcccttctctgcagtcagacggcacagttgcgactcagaacgctacgaaagtgtggaagcggaaggcgccggagacactctaccgcatcaggaccgctacgggcagggagctggatgtcacaccatcacaccctctcttcgttcagtccgacgggaggttccaggctaggaaggctgaggagctggagtctggcacccatgttgctgtgcccaggaaggtttcaactaacgcctgcaatgagctcgacgtcaccttccggcagtctcaggcccacaaccgcatcgacctcgatctgccaccacagtggacgccagagctcgctaggctgatcgggtacattgttgcggagggctacgtggagcagaggcctgataatacgggctacgtgtccatcacaaacaatgaccgggaggtgctggacgatgccaagagcgtcctggagactctcaacctgaatgtcaccgagcgctccagccacgaggggaagacggcgagggagctcctgtgcagcgctggcgagttcgtgtccttcctcgccagcctggacgagacactcctgcagtcgtctgctgagaggagggtcccgcaggatattatgagggcttccgacaacgtggtcaccgggttcattcggggctacatcgagggggagggccatgtgtcaacgtcccagcgcgagatcacagtcgcgagcatgtcgaagccgctcctggaggacgtcaggaccctcctggttacgcagggcattacagcccagctgcagccccggaacaatgggtcctacaggctcaggatctccggccagagcttccacgactacgcggagcagatcggcttcattactgcccgcaagaccgaggcttgcaggcagttcgaggggacgcatggcaacacaaatctggacattgtgccgaacctgggcccagagctcaggcgcatccgcgaggctctcgggctgactcagagcgagtgcggcctcccaaggtcgacctaccagcactacgagaggggcaggaggaatccctcgcgggattctctggagtcagtgctcgacgctttcgagactaggctggccgagatgaacaatgacactccaatttcggataccgctaggtctgacggcgggggcacgggctcgctcaggcaggatctcaacgggctggctgctctcgtggagggcgacatcgcctgggatcgcatcgagtccattgagcctatcgagcatgacgagaagtgggtctacgatctggagattgagggcacacataactacctcacaaatggggtcgtctctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3027 - DNA, 5444 bp, Artificial Sequence
  Synthetic Construct, AS-27 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgactgcggattcggacgttctcgttaggtcggagaatggggatattgagcgccagacggtggactctctcttctcggacgggcaggtggtcctcgcggacggcgataccgacatcgctgtttctaaggagacaccgactgtgctctcactggacgaggcgactgagagggtgagcgagcaggagtcgaccctcgtctctgagaggccactgagggacgatgagagcgtccgcaccatcgagacgtcgaggggcgctgtcaccgttacggacgatcacccaatgtacatcaggcaggacggcgaagtgactgtccggcctgcttccgacattgaggctgggaccgatctcgtggctgctaggaggccaccagacacgatggtcgagccatcagatgagacggttctgtcctgggagacattcgctgccgattgcgacaagcattctaagctctacggcgtcgactgcgggacagagctggctgctcagagggctgcgcgcgatgagtcccagactgctttcgctgagcgctacggctcgtacgggtctgctgtgggcaagtacgagaggggggagaaggacgttccggtgtggctcctgggcgagctcgacatcaggccagatcggattcacgggctgaactacgagacgtcgttcgagaatccattccctctggagtggtccccagagctggctcaggtcatcggctgcctcctgggcgacgggagcattcaccggaacgacgatgagaatgttgtggacgtgcgctaccataacacagatgaggctctcatcgagcgcttcgccagggacatcgagcgcctgttcgatattgagccaacagtcactgacaggcctggcagggagagccaccataagaggaagtaccaggtcgatgttccatcggctgtcggcagggtgctcgtctgcgttctggaggccgtgacggagaacggcacaccagggctcccagacgcggtccggcctgctttcgttggcgccctgttcgacgatgagggccacatctcccgcgaggggaaggcgttcattagcaatacagaccatactctcctgaccggcgtcggggagatgctcgctgagatgggcatcgagaccaagctcgcgccagaccagcacaagctgcatattaggggcaggaggaacctggagcagttcctggaccggatccctattgcgagcgatgagaagttctaccgcggcctcgatgctctggacgcctacgatgtgaccacgaggaaggctgagctcctggaggcgatcaggcaggagccaaagacctcggctgctctcgctcagactctgggcgtgaccagggggtccgtcaataagtacctcagggagctgcgggagtccggccacatcgagaagcagattgaggggtcaaaccggtccctcgacgagaatcgcacggttcagtatgtggcggctgatttcgagggctccgtgtacgctacgctgaggggggagccgtccagcgtgacagtcgaggacgttgagaggcgggagtacgacggccccgtgtacgatctgacggtttcagagaatgctccaaacttcgctgtcaatgggggggctgtggttcataactcttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3028 - DNA, 4376 bp, Artificial Sequence
  Synthetic Construct, AS-28 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtgcggggggacactacggtcgctctcgctgacgggtcggagcgggagattcgggatctcgtggaggctaatctggatgaccctcggccagttgacgatggggtgtgggacggcgtggatgtcgctgttccttccctcgctgctgacggcaggctggttcagcgcagggcgacaaaagtgtggaagcgggaggctccggagacaatgtaccgggtccgcactgctgctggccacaggctcaccgtcacgccatcgcatcctctgttcgtggctgggtctcacggcccagacgccgtcaggacggaggacctggaggttgggcagctggtgggcgtcgccccggacggcgatgggtcgggccaggtcgctccagacggcggggttatcagggatgctcagccagctccagtgggcgacgctgagaccgtcgcctggtccgcgatcgagagcattacggaggtcgagccggatgaggagtgggtgtacgatctggaggtggagggcactcattcatacctcacggatggggtcgtttcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3029 - DNA, 5141 bp, Artificial Sequence
  Synthetic Construct, AS-29 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcagttacgggggacaggccagtggtcgttagggatccggggggcacagttcgcattctcccaattgaggatctcttcgctagggggaccacggagtcagaggtcctcatcgctgctgacggcgatgtggtcgcttccgctacaccaggcaagactaggagggctctcgacgggtgggatgctctgtccgtgaacgaggacggcgaggctgagtggcagccaatcgcgcaggctattcggcacaacaccgacaagcctgttgtgaatctccagcataagttcggcgagtcaacaactacccgcgaccactcctacgtcgttccaggcgaggatgggctgacgacagtttccccagacgatgtggctgagccttaccgcgtcagcggcgttccagacgtggagcccgtcgagcaggtggatgtctacgaggttctcaggggctacgagagggagtacgaggacggcaggtcggtggggtctgataactcaatcacaaagaggaagcagattcacgcggacgatgagtatgtgtggttcggccatgagcaccatagggacgttgattcgaccgttaaggtgaagcggttcgtggacatcgattctgaggacggcgctgctctgattaggctcctgggggcctacgtcccagagggctccgccagcaccggggagactgcgaccagcaagttcggcgcttcgctcgctgagtctgacagggagtggctcgctcagctgcagagggattacagccggctgttcgagaatactaccgctggcatcattacatcggacaggagggctgagaggactgtggagtaccagacggacacaggcggggcttcggtcacctacaacgatgagacgctcaagctgcagatgatgaatgagctcgcggctgtgttcttcagggagttcgctggccagacgagcagggggaagcggatcccgtcgttcgtcttccacctgcccgaggagaagcaggacctcttcctgaccctcctggtggagggcgatgggagccgcgagttcccaaggtacacggaggcctacgcgcagcggaacttcgacttcgagacgacatctcgcgagctcgctgctggcctgtcaatgctcctgacgcagagggggcagaagcattctctcaagtaccgggactccaaggatagctacactatccgcacctgctccacgtacagggagggcagggacccagtcctgaccgaggctgaccacgatggctacgtgtacgacctctcagtggaggagaatgagaacttcgtggatggggttgggggcatcgtgctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3030 - DNA, 4475 bp, Artificial Sequence
  Synthetic Construct, AS-30 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttctcgggggatacggagatcgctctcgcttcgggggattctattactttcgagtcgctggtggacgcttacgagcggggggagacacactactgctacactatcggcgacgatgggcggatccgcattgaggagattatgaacccgcgggtgacccaggaggacgctgctctcctggccgttacgctcgataatggcgaggtcatcaggtgcacacccgaccatgagttcatgctccgggatggcaactactgcgaggcgcagaatctgaccgacgggcagagcctcatgccactgtacaggaccacgacagagatgactgagactaccgagacgacagagactaccgggacagctgagatggtgaagcagccgttcgcccagaacaattgggagtccgtcagccagctcgctaaccgctacaatcgcaggcacacgacaactgaccatatcgttgagacgcagcagattcagtcacagcagcagtcccagatcgagaccgtccagatttctgagagggcggacgttcacaaccataccgtgatctcggtcgagtctctgaccgagacggctgatgtctacgatctggaggttccagttactcataatttcgctctcgcttccggggttttcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3031 - DNA, 4457 bp, Artificial Sequence
  Synthetic Construct, AS-31 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3032 - DNA, 5546 bp, Artificial Sequence
  Synthetic Construct, AS-32 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcataccatcctaggtcggaggtcctgctcgctgacgggcagcggattgacatcggcactttcgtggattcgcgcattgagaagaataacgccaatgttatcgacggcattaactgcgagatcctgccggtggacgatattgatgtttacaccgtggacacagatactgggtccgctagcacggtttccattgacagggtgagccggcacccagctccatccgagttcatccgcgtgaagttcagcaacggcaggtcggttctcgtgaccccggagcatcccatgttcatcgacgatgggtcagagaccaagacggtccaggctaatgctctgagcggcggggagttcgttccagctcctcaccatctcccaggcgtgaacaccgacgcgtccagcgtctccgacgatatcaatgatgttagcaccattaggacgcacgtgaggtcccgggcgcgcgctaaggctgaggtcgaggttcgcgctacggacggcgagttcaagctcatcgatgccgcgcagaccctgggcatcattacggctgtggggaaggtgagcgtcgacgctccagagcggggcatcattgtcgacatggatcgcacagttgactcgtctaaggattcgatcaacaatgtcctggggtctgttattccttcaaacgacaatgattctatcactagggtccaggacacaggctcgactgggaaccagtggaggtggtctgtgaataccttcatcgagcggatgatcgagattgctccagctgtcacggctgacaggccaaacaggagggtgcctgatgctgtcctcggcgggagcgaggctgtggtccagcagttcctgacaggcgtgatcattgctgccgggcggatcctcgacgagactatccgcatctacgcttcatccaacgagctcgcctgcgactacgccgatgcgttcctcaggctgggcatcaccgcttccgtcgaggacgggccagctgagatcgcggctcagaccgtgatcaagtgcgacagcgattacgagcgcgcgtgcggcatgttcgacatcagctcgtctaggaccacgccctccgatacatcatcccagaacaatcagagctcggtcaccgcccagaacgaggacacgcaccagacaactagccatgagatcctcccgtcgggcattgcggatgagctgcagagcatcaggcagctcctgaacattcccgcctcggagcagctggcgtctatcacggctggcgacgatgggatcgcgctctcgattgctagggccgagatcaacctcctgcgggaccacattgagacactgcgcatggatactgagaatgtcagcattggccgcgacgattgcgttacaccgactatctcttcatccagcaagtacaagtacgcgaagaactcaatcacctccgacgagaatctccagctgttcggccagtcacaggcccagctgtccgagaggacaaagaccacggagtcgtcttcaatctcggcgtctactgacctcgtgtctatcccagctaacatttcagagaataggctcgtggctgctacacagaggctggacgaggtcgagactcgctgcaaccggcgctaccacagggtcatcgccgttgacacggtgtccaatgccggccctcatgcgtgcgagtgggtctacgatattactgtggagcctaccaacactttcatttcttccggggtcgttctgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3033 - DNA, 4904 bp, Artificial Sequence
  Synthetic Construct, AS-33 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcactcctgatacaaatgttctgacgcctaatggggttcgcaatattcgggatctcacggtcggggattcggtttactcgctgaacccggagaccatgcagatggagatcaagccggtgacacagactcacgagtaccccgactaccagggcgacctcatcgatattcagacaaacgagatcgatttccgcgtcactccaaatcataggatgctggttgaggctaccggcacggacaccacgtccaccaacgactacgatttcatcgaggccgggaatctcgatatttccagccggtacgagctgcctcacggctggtccgttgaccatacggatagcctcggggcctacatcgacctgattaccctcctgagggagcagtcagacacgtacaacgtcctctccgatggcgggatgacaactgctgctacggctgacatcaatcacaacaatgtcacccgcagggttgactctgatacgttcgtgtcactgattggctggtatgtggctacagggcgggtctcgcgcactcagaacggctctgacagggtctacctccagctgtcccagacaaatactaaggcgcggacccagctcacgatgctcctggacgagctgggcgtggactggcaggctgataacgagaagatccacttcgtgtctcatgtctggacggagctcttcgacaccacgtgcggccgcacagagaagaacaagcacatcccggagctgattttcgacgcttcagcctcccagaagagggcgttcttcgatgctatcattaacggcagcggggtcaagaatgacgattcgtaccagtaccacacctcgtctgaggacctcagggacgatatcctccggctgtgcgttcatatcggcattgtggcgcggtacgactacatcaacgatgagtcctggcgcattgagtgcaccgagacggccaatcccgacttcacactgactcatagcggcaggcagtcgacagctgaggatggggtttactgcgtgactgtggcggataatcagactctgctcgccgggaggaatggcaccttccagtggacaggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3034 - DNA, 5417 bp, Artificial Sequence
  Synthetic Construct, AS-34 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttccatcctgagactaagatttggttcagggacacagacaatgagtggcatcatgagactattcagactttcgtggaggaccgcctggacgatccagagatcgatgcggttggcacgctcgtgcaggaggtcgacgataacacagaccgggagatctctgtgccttcaattgacgataatggcaacgagcgcctgcagtcagttactgctgtgtccaagcacagggccccaaatcatctcgtgcagatcgagaccattagcggcagggagatcacaattactcctgaccacgagatgcatatcttcgagcagggcaacctggtgtcgaagcaggcttctaagatcacgtcaggggagtacgccgtcatcccgaagcgcctccagacgatttccccatccagccacacacctcagcatgatctcctgagggagttcctcacgcgggatgagctgacagccgacaggctcatcattcacacgtctgacccagtccggctctgcaaccgcgttttccctgaggaggtgacatcatgcaaggatgcggttgagatcatgcagaatactgcttgccatctggacaagaacaaggagaccctcatcggctggctgggcgaggggcgcattccggtcgctctcctgagggggttcgttgagacggacgaggcgctcctgatgagcatccccgacgatgttcagattggcctgaggggggagaaggtgcgcatcgacaggcacattggcttcacggaggagctcacatcgctcctgggctactacgctgctgctgggatcgtgcatacccagacgaatcccatttcctacgagagcgcgcagcaggagcagtcgaggatcaccttctacaacattgatacacagactcagaccgacctcctgaatgccctgaactctgtcttcgagatcgagccgattcagtacaacctggacggcgagatcctcggcgtgccaggggagctcattaggagggtcttcgatactgtcttcgacgttgggacccagccatcccacaagcggatcccccaggctctgttcgatgcctcagagtcccacatcacgagctacctgcgctgcttcttctccactcatgacagcctcaccacggataccagggacatcagcgctacaactgtgtcgcgggagttcaaggaggacatcattgctgctctcaggaggctgggcatcacagctgaggtcaccacgcagcagagcaggtcggtgccagaggtcctcccagactggtacgcgatcgacgatattacgcaccatgacgctgataattccctcaacctgacacggtcctacgtgatctctattgcgtcgtctgatgctgttaccctgcagagggacaggcaggctcaggagcagatcaagtacgacgcgcagggcctcatcgccaacaataacgcgattcaccagagcaggcaagtgactgatggcgggaggaaggactacatcactgagccgatcaccgacattgagtatgtggacgcggatatcgactacacctactgcctcactgtttcggagactcactcactcatcgttaatgatctctctcagaagcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3035 - DNA, 5462 bp, Artificial Sequence
  Synthetic Construct, AS-35 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcggtcgctgcggactcgcggctggtcgctgtttcgccggatgacaagatcgttttcactactattgaggatttctggaagaagctgaacacgccaatcgagcgcaatgggaagttccggaagcgcacatgcgtctctgagggctggcagacttacgctttcgacgagaaccacgaggcctcactgaggcctatcgagaaggcgattcggtacaccgctgatgagtctgagcagctcaggaggatcaccacgcagctcggcaggtcgctggacattacggatgagcactctctgttccgctacgacgatggcatcgaggaggtggctggggacgatctgaccgctggcgacatcattgtcgcgccgaggaccctcgatgttgaggtgacgcagacaactctcgacctgtccgagtacatccacgataacgagaggtgcccaagcgagcagaccggctcgggggagctcaatctggcctccaagagcgcgatctcggactctaggaacaaggagaccccgggcgtgacgcataatatcctcccccagcggagcaagttcaccgacgagatgaccacgctctcaccaacggctgttggcgggctggagtccgagcagaacgagaccctcagggtcggcgagagcacgggggccatcgagaggtacattaatgtggacgattcgttcggctggctcctggggcagttcatcgcgcagaggtcaatttccacagacgctctgaccatgacggtccacactgccgcggagaagcatgccgagcggatcgttgcgaccagcgactcggtgttcgggattaagccaacggtgaactccatcgagcgcggctacgagattgtgttcccttccgtcttcgacacaatcgtcagcggcctcactgcgaaggagcagagcgagcccgagcaggacgtggatcacacacatactgacgagatcggcattccggagtgcatcctgcacgcccccgacgatattgtcctctccttcctgcaggggttcatcctcgcggagaacgctcagcggaagggcaatgctgcctccgaggccagcgagatggtctctgagtcagagacaactgttaccctggagacgccatcggtcggcgttaaggacgggctcgtgttcctgtgccacaggctcggggtcatcacggatatttcggagaagtctggcgaggagtacagcgttcatttcgaggagtctcgctacacagtgtcaatcgccacagagggcaagactaaccccctcgaccagatcctgaatggggagaggccaacaatgcctgagggcgtgagcgtcccagttccagatgctctcctgactatccacgagtcaattgccaactccccacatatcgaccaggtcattcctgataccgtggtccagcaggagacagtttccctggagactctgcagagcctcctgaccggcctgtcgacggtggacctcccagctcagctggaggctaagcgcgacgagctcacactcctgactgagggcgatctctcttacctgagggtggagtcagtcgagtgcgttgactacgatggctacctgtacgatctccaggttgggggggagccagttttcacagctaattggctctacgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3036 - DNA, 5054 bp, Artificial Sequence
  Synthetic Construct, AS-36 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcactgcggactcaacagtcatgctcaaggagaaggggatggtctcggtctcggaggtggagacaggggatcagatcgctcagcgctccgacacaggcttccagtacaagccggtggaggagactcacgcgtacgagaacgctgagacactcactgtcaccctgacgaacggctgctctatccgcgggaccccgaatcacaggctcatggtcgacgatgagtggacgcgcatcgacgagattcagcccgatcaggaggttcattacacactcggctggctgagggagactaaccagtccccgcccaagctccactctcagtcacataccacggtgaatcagacagctgactccatcagcccggattccagcgagcccattgagctgtcggagtctgagaacgcggacacgggcaacaggcacaattctgctgttgccgtgaagcagtcacggacacagactcagctgatcagcgacgaggtggtctcgcggccagagcacaccaggaggcctgatcagctctccgaggagctggctgagctcctgggcctctggatcgacacggggctgtggcatcagagcggcgtccagttcaacgttgagcgcgagaatatcgcggagtacattgaccagctctcacagcagctgttcgataccccagctgctatctccgacacggatggcacctacacggtggacattacagatcataagctcaaggagtggtggaaggctaacttcggcgggaagccagacggcactcagtcgtcttacgtcccacagatgatcaaggaggcccctacaaatgttattgaggcgttcctgagggggtgcttcactgctgagggcgggctcaggaaggacatgaggccacggctgtgcacctcatccgaggatagcatcgacgatattgcggtcctcatgatgggcctggggtaccctgtggagaagtcggtcatcaggaacgctgacggcgagccgtactactcggttatgcccgctaccgacgatgggctctctgccttcctgcacgacgtgggcttcatcgatgagcggcgcgagatcgggctctccaacattgagagctcggatagccgggccctgaacaatacccataagatcgaggttgagtcaattgtggagtccccacctgcgacggtctacgacattacagtggcggataatcatgagtacgttacagatggcatcatttcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3037 - DNA, 5144 bp, Artificial Sequence
  Synthetic Construct, AS-37 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggaggagaatagcctggtttctaccgatgaggggctgcggcctatcaaggatctggacaatactactgcggagttcgagcagtgggacgagatcgatgtcggcgttaccacggacggcgggaccaagacggctacagctgtttacgataacggcttcgccaatgtgcgccagatccagaccgagagcgggttcaacattgctgctaccccaaatcaccggttccgcacgctgtccagcgacggcacttacacctggaaggaggctggcaagttcgagtccggggaccgcgtgatcctgcagaggaacaccttcgatgctggctcccgcgtgtccctggaggctaatgagagggctgacgatgcccaggacacaactgagggcccagagctgccagggaggatgacgtccgagctggccgagttcctcggctacttcatgggcagcgggtacatctcggacgagacccatgcttccgtggatctggtggtcgacagcgatgccacggagctcaactcatacctgtccaatctcggcgagcagctcttcaggattaccccggccgtcgagtctcaggagatgtcacaggttctgtccttccgggactgccacctcagccgctacttcgaggataacggctggaagaagacggacacaggccataatggggatgcttcggctgctttcgtcccagagcagatcctggagggcgacgagcaggttgtgaacggcttcctcaggggggtgttcgaggcgattgggacggtctcggagaagatcgagattctgaccacgtctacaactctggctgaccagctccagagcctcctgctctcgctgggccacgtgttcacccgggatagcacgaagctcgtcgagacaaacaattaccatgacgatcagctgaggcagaggctctgcggcgctactaggagggaggacgagcggttcatgaacgagatcgggtcactcattgagccagatgagctgaacctctccacacgcgcggacaagaatgatacttacccttcgtctgttatcgaccacgtgcagacactggacggctacgattcagtgtccgagagcctcaagtctcgcattaaccagtcacaggtcgacgggacggttagcaggaagctgatcaaggatattgaggcggagactgctgagaccgtctcgatcgccgaccatgagctcacaggcttctacgcggctactgtggagtctgtcacggaggacacagcgtacactaaggatatttcagttccaagcaacaacacatacatcgccgacgggttcgttactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3038 - DNA, 4472 bp, Artificial Sequence
  Synthetic Construct, AS-38 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttctattgaggctgatgagtcaatcgttattaggcgggacggggagactgagctgacggagatcgggtcgttcgtggacactattctggccgcggacaaccaggagacccggatcacggatggccacgagattgcgctcgctccgaatgggctggaggttccctccctcgacaccgatgagcagatcaggtggaagcacattgaggcggtgagccggcatgcttcgccagacgagatcctcctgattgagctggagtcaggcaggtccatcagggctaccaaggctcactccttcgtcacgaggagggacggcgatgttctcccagtggctggcgagacactggtggtcggggacgtcctccctactgttggcagctacgatcatgcgtcggggtctatctcagtgccgctgcagtcccagagcgtcgctgctgacggcgggaccgttgagcccaacacaaatatcactgccaacgcggagcgcgattcggcctctattacctctgcgggcatcattgggtcggctacgtgggagaggatctccagcattgagacagtggcgccggagtacgagtatgtgtacgatctctctgtttccgggctggagactttcactacgggggagggggtcgttactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3039 - DNA, 5114 bp, Artificial Sequence
  Synthetic Construct, AS-39 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcactgcggggacaagggttctgcgggctgatacgggggcggagactactatgggggagctgttcgcgctgcaggctagggacgttccggtgtggtcactcgacgagtccctgcgctacgtccgcaggcacctcactagggttttcccaaccggggtgaagccagtcttccggctgaggactgctagcggcaagactgtccgcgctaccgctaaccatccattcctcacctacgatgggtggaagcctctcggcgagctgtcggtggctgacaggctggcggttccgaggcacgtgccagctccagagagggtggcttcatggacggacgatcaggtcctcctgctcggccatctcatcggcgatgggtccttcgtcaagaggcagccactccgctacgctagcgttgacgaggctaacctgtcggctgtgacggaggctgctgctaatgccttctccattgtcgcggttcgggacgagtacgctgctgctaggtgcaccacgctcaggctgccagctccttacaggctgacccacggcaggaggaatccactcgctgcttggctggacgagctcggcctgttcgggctcaggagctacgagaagttcgtcccgcaggaggttttccacctgcccaagaggcagatcgctctcttcctgcggcatctctgggcgactgatggctctgtgacgctgacaaggcagtcacgcggcgggaggatctactacgcctcgacatctctccagctgattcaggacgtctccaggctgctcctgcggttcggcattagcacgagggtgcggacaactaccccaaagggggaccacaggcctggctacacactcgatgtttctggcgtggacgatcagaggcggttcctgcaggagatcggcgtccatggggccaggggcgctaccgctgacaggctcctggaggtcatcagggatgtctccgcgaacacgaatgtcgacacagttcccaggcaggtttgggacgatgtgcgcaggctcctggtggagaaggagatgacgcacagggagttcgctgctgctatggggacatcgttcggcgggtccagcctctggaagcatgctccatctcgcgagaggctcggcagggtggcccaggtcctggactcggccgagctcgatgttctggcggtgaacgacgtcctgtgggatgaggtggtcgcgatcgagcctgacggcgaggagcaggtctacgatgctactgttctcggggggcacaacttcgtggcggatggcattgctgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3040 - DNA, 4970 bp, Artificial Sequence
  Synthetic Construct, AS-40 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacggctgacacatgggttatgacggcctcgggggctaggcaggttcgggatctcattgacaggccattcgaggcggtcgtggacggcgagtgccacccaacagagtcccgcggcttcttcttcactggggataagcctgtgctcaggctgtcgacggctgagggccacacactcaggctgactgcgaaccatccggttctcagggtgtccaagatgaccaggcagctgcgggagacggagtgggttaaggctggcgagctcaggccacacgacaagatcgtcctccacgatcatagggctctgccatcctgggacggcgctcataccgaggctgagggctacctgatcgggctcctgattggcgggggcaccctcacgagggacaaggctatcctgtctatttgggatgctgctgctccaaaggtggctaacgggggcggctcagtcccagctgctggcgtcgccggggttatgagggctgctgagctcgctgctcggaccctgccacaccgcacggacttcaatggctggcagaccacgatggagggcaggggggagtaccacatggctacaggcgccctccatactctcgctctggagctcggcctgacaccaggggataagcgcctcactgcgcctctggagacaacttccagcgctttccacaggggcctcctgagggggatgttcgacgccgatggctcggttcaggggtctcagaggaagggcgtgtccatcaggctcccacagaccgacctcgggaacctgcagacggtccagaggatgctcctgaggctgggcgttgctagcaccattcatcagaataggaggccaggcgggaccaaggtcctcccagatggcgagggcggggctaaggggcactcatgccaggccgcgcatgagctgatcatttccggcgagaatgtggtcaggtacgctgagcggatcggcttcgccgactcggataagatggacaggctcaccgctctcctgcagaggtacaggcacacgaggcatgctgagaggttcatcgcgacagtgcagagcctggaggacgatggcatggaggccgtctacgatgttacagtggcggacgttcatgctttcgatgctaatgggctctacgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3041 - DNA, 4325 bp, Artificial Sequence
  Synthetic Construct, AS-41 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgcgggggacactgagattactgtttcggacgggcggcgctggatgtcgctccctattaggcagttcgttactgagaatttcgacatctcaaagccgggcctcgatcacgttgggacattctactccgacccaaggcagccattctacgtccgctcgattgattctcagggcaagacaagcctcaagcgggtgacttccgtcagcgttcacagggctccagctcatctggtccggttcgctaccaggagggggagggtcctcaccgttacgcctgaccatgcgatgctggtgtgggacacggattacctccgcaagatcaaggctctggaggtggctgtcggcgacagggttccagtggaggagggcgggctcgtggtcgctgatgaggttgtgtctagggagacggtgcaggctctggacgatcgggtctactgcctcactgtggcggagaatcatactctcgttgctaatggcatcttctgcgggcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3042 - DNA, 4640 bp, Artificial Sequence
  Synthetic Construct, AS-42 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctgcgggcactctcatcaagacaccaaaggggcctgttcctattgagcagattcagtcgggggatctcgttttcaatgcgatcggcattggggtggtcgagggcatcgtgtgccagcagaagcagaccattacgctggagctgtctgacggcacatcaatcgtctgcactcacgatcatccattcttctgccctcgcggctgggtcgctgctggcgacctggaggttggctccgggctgttcagccacgaggatctccgcaggctgtggtcgggcggggcttctctcggcctggagtccgggtccagcgacggcaggggggctgttcgctcgtctgaggtgctcctgaggatcctcagggaggaggctcgcgagccagatgctggctactgcgggccagccgaggacgtgcgcaacgcgtctaccgatagggctcatgctgagggcgcttggtggcagtggcaggctgacccgattgcgtcagatgaggctgctaggtccgctggcaggagggtcgctgaccgcgttagggacgaggataggagggaggctaggccagagccaaccgctgtcctcctgcaggacaggcactgcgagccactggctaacgatcggaataggagcggcagggagcattcatcccggggcacgggggaggctgagggccagcggcagggggacgtgccatgctcggtccgcgttgtgagcatctcgcgcgaggagaggggcgggcctgaggcggtgtacaacctcagggtttcagggcatccaagctacttcgctgggggggttctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3043 - DNA, 4325 bp, Artificial Sequence
  Synthetic Construct, AS-43 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttccatggggacacactcattgagatctacgctgacggcattctggaggagattccgatcaggcggttcgttctggagcatctggatctctcgcaggctggcgtggacgctctggggacgttctacgctgatccggtccggccagctcacgtgcgctccgtcgacacaggcgggatcccacacctccgcaagattacttccgttagcgtgcataaggcccctgcgaacctgatccagttctcgacctctaggggcaagaatctcctggtgacgccggatcatgctatgctcgtttgggacgtgtcctacctccgcaagatcagggccctggaggtcaagattggcgacgctgtcccagtttgggagtcaggggtggtcatctccgacaggatcgtcagcattgattacgttccctgcgaggacgagcgggtgtactgcctcactgtggatagggatcataatgttgtgggcaatggcatcttcactgggcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3044 - DNA, 5327 bp, Artificial Sequence
  Synthetic Construct, AS-44 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgcaccctgacacatacgttattctccctgacgggcgcatgaagaagatttcggagattgatgaggatgaggttctctcagtcaacttcgaggacctgaagctctacaataagaagatcaagaagttcaagcacaaggctccgaagatcctctacaagattaagaccgcgttctccgagctcatcaccacgggcgagcataagctgttcgtggtcgagaacgggaagatcgtcgagaagtgcgttaaggacctcaatggcagcgagctgatcggggttgtgaggaagctgaactactcgttcaacgacaatgtcgagttcaaggatgtctacgttgagcgccactacaagctcgacgagacaatcaggaacaagctgcgcaaggtgagggagaagctgggcctcactcggaaggatgtggagaagctctgcggggtcaaggagatctacattgttaagatcgagacaggcaagctggagtcaattgaggaggagcggctgaagaagctctgctccctgtacgggatcaacttcgaggagatcatctaccgcgacaacctccactacactaatccagtcaagttccctaagacaccgactcccgagctgatgcagatcattggctacatcattggcgacgggcatttcccctcgaatcggatgctgcgcctcaaggatgagcgcaaggaggtcctggaggagtacaaccagctgttcaagacggtgttcaacctggagggcaatatcaagaagggcgacgggaactactacatcctggagatcaacagcaagtacctgatcgattggttcagggagaacattccggagctcttcaacaagacaggcaatgagaggactcccgagttcgtgttccggctcaacaatgacctggtcgcttcttacctgcggggcatcttcgatgccgaggggtacattcgcgccgaggcgaagcagatcggcattgggatgacatcaaagtgcttcatcaaggagattcagttcctcctgctcaggttcggcatcctcgcctcctacagcaagattaagcggaaggaggagaactggaacaatacccataagctgctcatctcggacaagaagtctttcgagctgttcaagaagtacatcggcttcacggcgaaggataagatggagaagctggaggctatcctgaacaagatgaagggcctcaatttccgctacatctccattccactgaccaagaaggagatcagggagttcgtgggcgtccctctgaagacgattaagaacggggacaattactgcaccgattacacgatcgagaagatcattgaggagctcaactccaagggcctgtacgacaaggccgagtacctcaagcgcttcctggacgcggatatcgtttggacgaagttcaagattgaggaggtggagagcgatgttgagtatgtgtacgatctggaggtggaggactaccacaacttcattggcaatctcatcatcaaccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3045 - DNA, 5333 bp, Artificial Sequence
  Synthetic Construct, AS-45 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcaacgctaacactgagattctgcaggagtcggggttccgcaagattacggagctgaataaggatgagaaggttttcgcgctgtgcggcaaggagatcaagccagtcgacgggtggaaggttcacaagacgcctcagcatgagtacaacatcgtggtcaagacagtcaatggcctggagattaccacgacaccaaaccacatcttcctcgttaaggagaatggctcgctgaaggagaaggaggccaaggacctgaaggttggggattacgttgcgacggtggaccggattcgcgtgaaggagaaggacatcgatctctctaacggcgacctgtacttcattgggtacttcatcggcgatgggtacacaggcgtgatcgagaagaacacgctcaaggctacaccggatctggccttcaaccccaagtacccgcccaatttcgacgattcggagctccacaagaagtacttcctgaagtgccggatttcaaagggcgtcgctcattacatctactccaagaagctccgcaagattttcaacaagctcaatatgctgaccaaggacaacaagaatatcgatgcgttctgcaacctcccgctggacaagctcgcctacctgatcgcgggcctcttcgactccgatgggtacatctacctgaaccggaagaatattgagttctactcgatctctgagaagctcgtggagcagctgcagttcgtcctcctgcggttcggcattcactccagcatccgcaagaagaagaccaagaccatggtgtccccaactaacgggaaggagtacaagtgcaaggacatctacgtcctcaccatccgcgatttcatgagcattaagaggttctacgagaacatccctctccgccatgaggagaagcgcaggaagctggaggagatcattaagaataaggagatcggccagattccgtctgagttcgttgcgctgaggttcacccccatcgctaagatttggtgcgactgcggcttctcagtggatctcactatgttcaagccgcgcaccaagaggcagcgggagctgaacaagaagagggtgaagctcctgttcgagctcctggacggcaagaagctcatcacgaactacaaggagtactacagcaagaggaagaatccctacttcgatttcattgtccgggagaagatcaacggcaacaattactacagcctcaatgagaaggggagggttctgatgtcgctcctgaacaagcacatcaaggacaaggagaatctggaggagatgtacaacttcctcgtgaatctggagaagtgcccaatttgcggcaagcctatccataaggagatgaggtactcctggaagaaggagtgctacgacggggatatctactgggaccggatcaaggagattaagaagatcaaggtcaacgacaagtacgcctacgatatcgagctgccagatgacgggtctaattcacactacatcgttgctaacggcttcatcgtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3046 - DNA, 5006 bp, Artificial Sequence
  Synthetic Construct, AS-46 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttccgcctgacactctgctcatcctggagaatgggttcaagcgcatcgtggacattaaggtcggggacaaggtcctgacgcacgagaaccggttcaagaaggttgagaaggtgtacaagcgcaggtacatcggcgacatcattaagattaaggtgcgctacttcccagaggagatcattctcaccccagagcaccctgtctacgctatcaagacggagaagaggtgcgatggctctcatgggatctgcaagttcaactgcctcacacagtacactaatccttcatgcaagaagcggtaccgcaagtacaagagggagtggatcattgccaaggacctgaaggtcggcgatgtgatcgtctacccgattcccaacagggttcgggacatcaagtacctctccctggataagtacctcagcaatatcaagagggagttctgccgctcccgcatcccggagaagattgaggtctctgaggagttctgccgcctcgttggctacttcctgtccgaggggtactgcttcagggacggcatcgggttcgctctgggcgagaacgagaagaagatcattgacgatatcgagtacctcatgaagaagattttcaatctgaagcccaagatccgcgacgatggccgctcagaggggatcgagctcaagtactactcccgggtgctgcgcgacttcttcggcgatatgttctactgcggggacgagaagcgggcctggaacaaggcgctcccaaatgagttcctctacctgcctaagaacaagcagctgcagatcttcattggctggtggaggggcgataagggggtcaccacgtcggagattctgatgaaccagctcaggctgatcagcctccggctgggcttcatcattaccttctcgaagcacgttccgaagaatcccaagatcggcgacagggaggtcatcaagtaccatgctaggtggcagggccgcgtgtccatcctcgacgagaagattgtcgatgagctcaagaacgaggacatcaagctgccgaagaaggatgttcgctacggctggatcaaggggaattacctgtacgctcccatcattaggatcggccgggagtactacgacgggttcgtctacaatctggaggtggaggatgactcttcatacgttacagtctcaggcactctgcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3047 - DNA, 5468 bp, Artificial Sequence
  Synthetic Construct, AS-47 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgatgccgcatgagaaggtgctgacggagtacggggagattaagattgaggacctgttcaagatcgggaaggagatcgtggagaaggacgagctcaaggagatcaggaagctgaatattaaggtgcacactctcaacgagaatggcgagatcaagatcattaacgccccatacgtgtggaagctcaagcataaggggaagatgatcaaggtcaagctgaagaactggcactcgatcaccacgacaccggagcatcccttcctgaccaacaatggctggatcaaggcggagaatattaagaaggggatgtatgtggctatccctcgcaagatctacggcaacgaggacttcgagaagttcatcgagttcattaattccaagatcctcacgaacgagctgattgtgaaggtcaatgagaaggacctcaagaacgttgagctgccgtcaacaaagatctacaagaagcagaagaacgtgttccgctccgaggatatcattgagcacaacctcaatatcgagaagatttcgttctctccacggatccaccgctgcggcaagccacagcattacatcaagctccctaagtctctgaacgagtggaaggccatcttctacttcgctggcgtgatgttcggcgacgggtgcgtcgatcggatcgcgaacaatgacgaggaggtcttcaacaagctgaagtcactcaacaatctgggcatcgaggttgagaggattaagcggaagtccagctacgagatcattttcaagaacgggaagaatgctctcatcaacctcctgaagattctgttcgattacccgtctgagaagaagtcacataacatcaagattccgcagatcctctacattgctcccaaggagctggtggccgagttcatcaagggctacttcgacgccgatggctacgtgaatctccgccagaacaggatcgaggttatttcagcgtccaaggagttcatcgagggcctgtccattctcctgctccgcttcgagatcacttccaagatctacgagattaagaagagctacaaggagaccaagaagaagtactaccagctcaacatcgtcggcaagaggaacctgaagaatttcaagaacatcgggttctccattaagtacaaggaggagaacctgaataagatcattgagaagagcaggaagtcggagaagtaccccatcaacaaggacatgaagcgcctcaggattctgttcggcatgacgcggaatgaggttaacgtgagctactacgccaagtacgagaacgggaaggagatcccatcgtacgagattgtgaagaagttcctcaattctctgaagcctaagaacctcgataagaagatcaaggttctggagggcaaggagcgcgacgtgaattacctcaaggctttcgagagcgatggcctgatcgagaacgggaggctcaccaagctgggcagggaggccctcaatatctggaagaaccacgagttcgggaaggagaatatcgactacatgaagtcgctgatcgagaacattgcgttcgtcgaggttgaggatgtcgagatcattgactacgatggctacgtttacgatctcacaacagagactcataacttcattgctaatggcatcgtggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3048 - DNA, 4334 bp, Artificial Sequence
  Synthetic Construct, AS-48 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctgctctcgcctacgatgagcctatctacctctcggatggcaacattatcaatatcggggagttcgtggataagttcttcaagaagtacaagaacagcatcaagaaggaggacaatggcttcgggtggatcgatattggcaacgagaatatctacattaagtccttcaacaagctcagcctgatcattgaggacaagcggatcctccgcgtctggcgcaagaagtactcggggaagctgatcaagattaccacgaagaaccgcagggagatcacactcactcacgatcatccggtttacatctctaagaccggcgaggtgctggagattaatgccgagatggtgaaggtcggggactacatctacattcccaagaacaataccatcaacctcgatgaggttattaaggtggagacggtcgactacaatggccacatctacgatctgactgtggaggataatcatacttacattgctggcaagaatgagggcttcgctgtttccaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3049 - DNA, 5066 bp, Artificial Sequence
  Synthetic Construct, AS-49 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcattgagggggacgctaagattctgacggatcgggggttcctgaagatgaaggaggtttacaagctcgtgaagaatggggagaagctcaaggtcctcggcctgaatgctgagacactgaagactgagtggaaggagatcattgacgctcagaagagggaggctaggcgctacgagatcggcgtgtaccgcaagaataagaacaccaaggacacgatcaagattacaccggatcacaagttccccgtgttcgtcaacggcgagctcagcaaggtgcagctgtgcgacatcattgataacaatctctcagtcctgtccatcgactacattccaatgatcgaggagaagtacgagtccctcgctgaggtcatgtacctcggcggggctgtcctgagcgatggccatatcgttcggaggaacgggaagccaattcgggtccgcttcacacagaaggacactgaggagaagaaggatttcatcgagaaggttaagggcgacgtgaagctcatcggcgggaatttcatcgagatttcgaaccgcaacaatgtcatcgagtaccagacctctaggaagattccgtcagagatcctgggcttcattgaggttaatattaacacaatccccctctacgccactaaggacgagatcgccgatctgattgcgggcttcgttgacggcgatgggtgcctctccgggaagaggagggtggagatctaccagaactccagccacattaagaagatcgagggcctcatcgtcgggctctacaggctgggcatcattccgaggctgcggtacaagcggtcgtctaccgcgacgatctacttcaacaacaacctggagaccatcctgcagcgcacgcgcaggattaagctcgacaagctgaaggagttcaagaagccagtggaggacaagaagctgatcgatatttcgcagatcctccctgagctgaaggagttcgactacaagggctacctctacaagacctacaaggagaagctgttcatcgggattaacaagctggaggagtacctgtctaagatcgacaaggatggcattgagcgcatcaagcagaagatcaagctcctgaaggagagcgacatctactcgatcaggattaagaaggtcggcgaggattacggggaggtctacaatatcacggttaaggcggagaacgagttcaatcataactacgtggtttggactaagcattacacacctatcgtggttttcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3050 - DNA, 4937 bp, Artificial Sequence
  Synthetic Construct, AS-50 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgccatccaaaggggacaaaggtcgtggtcaagggcaagggcatcgtgaatattgaggacgttaaggaggggaattacgttctcggcatcgacggctggcagaaggttaagaaggtctggaagtacgagtacgagggcgagctcattaacgttaatgggctgaagtgcacaccgaaccacaagatccccctccgctacaagattaagcataagaagatcaacaagaacgattacctggtgagggacatctacgcgaagtcgctcctgaccaagttcaagggcgaggggaagctcatcctgtgcaaggacttcgagacgattggcaactacgagaagtacatcaatgacatggatgaggacttcatcctcaagtccgagctgatcggcattctcctggctgaggggcacctcctgaggagggatatcgagtacttcgactccagccggggcaagaagcgcattagccatcagtaccgcgtggagatcacggtcaacgaggatgagaaggacttcatcgagaagattaagtacatcttcaagaagctcttcaactacgagctctacgtgcgccgcaagaagggcaccaaggccattacgctcgggtgcgcgaagaaggatatctacctcaagattgaggagatcctgaagaacaaggagaagtacctcccgaatgccatcctgcgggggttcttcgagggcgacggctacgtgaacacagttaggcgggctgtggtcgttaatcagggcactaacaattacgataagattaagttcatcgccagcctcctggacaggctcggcatcaagtacagcttctacacatactcgtacgaggagagggggaagaagctgaagcgctacgtgatcgagattttctctaagggcgacctcattaagttctcaatcctgatttcgttcatctctcgcaggaagaacaatctcctgaacgagatcattaggcagaagactctgtacaagatcggcgattacgggttctacgacctcgacgatgtgtgcgtctcactggagtcctacaagggcgaggtgtacgatctcactctggagggcaggccttactacttcgccaatggcatcctcactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3051 - DNA, 5258 bp, Artificial Sequence
  Synthetic Construct, AS-51 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctagcattctccctgacgagtacctgactattattgaggaggatggcattaaggtcgtgaagatcggggagtacattgatgatctcatgcgcaagcacaaggacaagatcaagttctcgggcatctctgagattctggagacaaagaacctcaagactttctccttcgataagatcacgaagaagtgcgagattaagaaggtgaaggcgctgatcaggcacccatacttcggcaaggcttacaagatcaagctccggtctggccgcaccattaaggtcacgagggggcattcactgttcaagtacgagaacgggaagatcgtcgaggttaagggcgacgatgtgcggttcggggacctgatcgtggtcccaaagaagctcacctgcgtcgataaggaggttgtgatcaacattcctaagcggctgatcaatgctgacgaggaggagatcaaggatctcgtcattaccaagcacaaggacaaggccttcttcgttaagctcaagaagacgctggaggatatcgagaacaataagctcaaggtcatcttcgacgattgcattctctacctgaaggagctcggcctgatcgactacaacatcattaagaagattaataaggttgacatcaagattctggatgaggagaagttcaaggcctacaagaagtacttcgacaccgtcatcgagcatggcaacttcaagaaggggcgctgcaatattcagtacatcaagattaaggactacatcgcgaacattcccgacaaggagttcgaggattgcgagatcggcgcctactcggggaagattaatgcgctcctgaagctcgacgagaagctggctaagttcctcggcttcttcgtgacacgcgggaggctgaagaagcagaagctcaagggcgagactgtctacgagatctcagtttacaagtccctcccggagtaccagaaggagatcgctgagacattcaaggaggtcttcggcgccgggtccatggttaaggacaaagtgactatggataacaagatcgtgtacctcgtcctgaagtacattttcaagtgcggcgacaaggataagaagcacatccccgaggagctcttcctggcctccgagagcgtgatcaagagcttcctggacggcttcctcaaggccaagaagaacagccataaggggacctcgacgttcatggcgaaggatgagaagtacctcaaccagctgatgatcctcttcaatctggttggcattccgacaaggttcactcccgtgaagaacaagggctacaagctcaccctgaatccgaagtacgggacggtgaaggacctcatgctggatgaggtcaaggagatcgaggcgttcgagtacagcggctacgtctacgatctctctgtggaggataatgagaacttcctcgtcaacaacatctacgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3052 - DNA, 5474 bp, Artificial Sequence
  Synthetic Construct, AS-52 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacgggggacactaaggtcatcgtgaatggggagattcgggagatcggggaggttattgaggagatttctaacgggaagttcggcgtgacactcactaacaatctcaaggtcctgggcatcgacgaggatgggaagattcgcgagttcgacgtgcagtatgtgtacaaggataagaccaacacgctcatcaagattaagacaaagatgggcagggagctgaaggttaccacgtaccacccgctcctgatcaatcataagaacggcgagattaagtgggagaaggcggagaacctcaaggtcggggacaagctggctacgccccgctacatcctcttcaatgagagcgattacaacgaggagctcgctgagtggctgggctacttcatcggcgacgggcacgccgataaggagtcgaataagatcacattcactaacggggacgagaagctgcggaagcgcttcgccgagctcaccgagaagctgttcaaggatgcgaagatcaaggagcgcattcataaggacaggacgccagatatctacgtcaactccaaggaggcggttgagttcatcgacaagctcggcctgagggggaagaaggctgataaggtgcggatccctaaggagattatgcgctcagacgctctcagggcgttcctgagggcttacttcgactgcgatggcgggatcgagaagcactccattgttctcagcaccgcttcgaaggagatggccgaggacctggtgtacgctctcctgaggttcggcatcattgccaagctgcgggagaaggtcaacaagaacaataacaaggtttactaccatatcgtgatttccaactcctccaacctccgcaccttcctggacaacatcggcttctctcaggagaggaagctcaagaagctcctggagatcattaaggatgagaatccgaacctggacgtgatcacgattgataaggagaagatccggtacattagggaccggctcaaggtcaagctgacacgcgacatcgagaaggataattggtcctacaacaagtgcaggaagatcactcaggagctcctgaaggagatctactaccggctggaggagctgaaggagatcgagaaggccctggaggagaacatcctgattgactgggatgaggtggccgagcgcaggaaggagatcgcggagaagacaggcattcgctccgaccgcatcctggagtacattcgggggaagcgcaagccaagcctcaagaactacatcaagattgccaatactctgggcaagaacatcgagaagatcattgacgcgatgcggatcttcgctaagaagtactcgtcttacgcggagatcggcaagatgctgaatatgtggaactcatccatcaagatctacctggagtctaatacccaggagatcgagaagctggaggagattaggaagacggagctcaagctggtcaaggagatcctcaacgacgagaagctgatcgattctattggctacgtcctcttcctggcgtcaaatgagatctactgggacgagatcgttgagattgagcagctcaacggggagttcaccatctacgatctgcatgttccacgctaccacaacttcattgggggcaacctgcctactattctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3053 - DNA, 5138 bp, Artificial Sequence
  Synthetic Construct, AS-53 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcggtctctaaggacacacctattctcgtgaagattgatggcaaggttaagcgcactactttcgaggagctggacaagatctacttcgagaccaacgacgagaatgagatgtacaagaaggtggacaacctggaggtgctgacagtcgatgagaatttccgggttcgctggaggaaggtgtcgactatcattaggcacaaggtcgacaagatcctccggattaagttcgagggcgggtacattgagctgacgggcaaccattccatcatgatgctcgatgagaatgggctggtggccaagaaggcgagcgacatcaaggtcggcgattgcttcctctcgttcgtcgcgaacatcgagggcgagaaggaccggctcgatctgaaggagttcgagccaaaggacatcacctcccgcgtcaagatcattaacgacttcgatatcgacgaggatacggcttggatgctcggcctctacgtggctgagggcgctgttgggttcaagggcaagacctcaggccaggttatctacacgctcgggtcccacgagcatgacctcatcaacaagctgaatgacattgtggataagaagggcttcagcaagtacgagaatttcacaggctcggggttcgaccggaagcgcctgtctgcgaagcagatccgcattctcaacactcagctggctaggttcgtggaggagaacttctacgacggcaatgggcgcagggctaggaacaagcggatcccggatatcattttcgagctcaaggagaatctgagggtcgagttcctcaaggggctggctgacggcgattccagcgggaactggcgcgaggtggtcaggatttcgtctaagtctgacaatctcctgatcgatacagtgtggctcgccaggatctcaggcattgagtcatccattttcgagaacgaggcgcggctgatctggaagggcgggatgaagtggaagaagtctaatctcctgccggccgagcccatcattaagatgatcaagaagctggagaacaagattaacggcaattggcggtacatcctccgccaccagctgtacgagggcaagaagcgcgtctccaaggacaagatcaagcagattctggagatggtcaacgttgagaagctgtccgacaaggagaaggaggtttacgatctcctgaagaagctgagcaagaccgagctctacgcgctggttgtgaaggagatcgagatcattgactacaacgatttcgtctacgacgtctctgttccaaacaatgagatgttcttcgctggcaatgttccaattctgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3054 - DNA, 5459 bp, Artificial Sequence
  Synthetic Construct, AS-54 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacgggggacgctaagattactctgcctgacgagcgggagatcaagattgaggatttcattaagatgttcgaggagcgcaagctgaagcacgtcctcaacaggaatggggaggacctggtgctcgctggcgtcaagttcaactccaagatcgttaatcacaaggtgtacaggctggtcctggagagcgggagggagatcgaggctaccggcgaccataagttcctgacgagggatggctggaaggaggtgtacgagctcaaggaggacgatgaggttctggtgtacccggctctggagggcgttgggttcgaggtggacgagcgcaggatcattggcctgaacgagttctacgagttcctcacaaattacgagatcaagctggggtacaagccactcggcaaggcgaagtcatacaaggagctgattactcgcgacaaggagaagatcctctctagggtcctggagctctccgataagtactccaagagcgagatccggcgcaagattgaggaggagttcggcatcaagatttctctgaccacgatcaagaacctcattaatgggaagatcgacggcttcgccctgaagtatgtgcgcaagatcaaggagctcggctgggatgagatcacctacgacgatgagaaggctgggatcttcgccaggctcctgggcttcatcattggcgacgggcacctgtcgaagtctaaggagggccggatcctgattacagctactattaacgagctggaggggatcaagaaggatctggagaagctcggcatcaaggcctcgaacatcattgagaaggacattgagcataagctcgatgggagggagatcaagggcaagacctctttcatctacattaacaataaggccttctacctcctgctcaacttctggggggtcgagattggcaataagacgatcaacgggtacaatattccaaagtggatcaagtacggcaacaagttcgttaagagggagttcctgaggggcctcttcggggctgacggcacaaagccttacatcaagaagtacaacatcaatgggattaagctgggcattcgggtggagaacatctccaaggataagactctggagttcttcgaggaggtcaagaagatgctggaggagttcgaggtcgagagctacattaaggtttcgaagatcgacaacaagaatctgaccgagctcatcgtcaaggccaacaataagaactacctgaagtacctctcaaggatctcctacgcgtacgagaaggacaatttcgctaggctggtgggcgagtacctccggatcaaggaggcgtacaaggacatcattctgaaggagatcgccgagaacgcgctcaaggaggccgatggcgagaagagcctgagggagctcgctaggaagtacaacgtcccggttgacttcatcattaatcagctgaaggggaaggatatcggcctcccccgcaacttcatgacgttcgaggagttcctcaaggagaaggtggtcgacggcaagtatgtgtccgagcggatcattaagaaggagtgcatcggctaccgcgatgtgtacgacattacttgccacaaggatccttctttcattgctaacggcttcgtctctcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3055 - DNA, 5312 bp, Artificial Sequence
  Synthetic Construct, AS-55 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacaccggacacatacgtggttctcggggacgggcggattgagactattgaggacatcgtgaatgctaaggagcgcaacgtgctctccctggacctcgataacctcagcatcaagattgacacggcgatcaagttctggaagctgcgctacaacggcaatctgagcaagatcacactctcgaacaattacgagctcaaggctactccggaccactgcctcctggtgctgagggataaccagctcaagtggatccccgccaaggacattaaggagaacgattacatcgcgatgccgttcaattacaaggtcgagcggaagcccatctccctcctgaacctcctgaagtacctggacatcacagatgttctcattgagttcgacgagaactccactatcttcgagaagattgccgagtacatccgcaacaatattaagacctcaacgaagtacaagtacctcaggaaccgcagggtcccgctgaagtacctcatcgagtggaatttcgacctggatgagattgagaaggaggctaagtacatctacaagtccgttgccgggaccaagaagatccccctgttcaagctcgacgagaggttctggtacttcgctggcctggtcctcggcgacgggtcgatccaggattctaagatccggattgcccagaccccactgaaggacgtgaagagcattctcgatgagacgttccctttcctgcacaactggatctcgggcaatcaggtcatcatttctaacccaatcattgccgagatcctggagaagctcggcatgaggaacgggaagctcaatggcatcattttctcactgcctgagtcctacatcaacgccctcattgcggggtacttcgacaccgatggctgcttctcgctcctgtacgacaagaaggcgaagaagcacaacctgcgcatggtcctcacgtcaaagcggcgcgatgttctggagaagatcgggatctacctcaactccatcggcattctgaatacactccataagtctagggaggtgtactcactcatcatttccaacaagagcctggagactttcaaggagaagatcgcgaagtacctgaagattcggaaggaggctttcatcaacggctacaagacatacaagaaggagcatgaggagcgcttcgagtgcgacctcctgccagttaaggaggtgttcaagaagctcaccttcgagaagggccggaaggagatcctgaaggactccaagatccacattgagaactggtacaaggagaagaccaacaatatcccgagggagaagctgaagacggttctccggtacgcgaacaatagcgagcataaggagttcctggagaagatcgtgaacggggacatttcgttcgtgcgcgtcaagaaggtggagaatatcccgtacgatggctacgtctacgatctctctatcaagcataatcagaacttcatctctaatggggtcatttcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3056 - DNA, 5189 bp, Artificial Sequence
  Synthetic Construct, AS-56 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctggggcgggatgagctgattttcattaaggagggggacaagctgaaggtttgcaagatcggggaggctattgatgagttcatggagaagtacaaggataagatcattgttgatggggacacggagatcctgtacctcgacggcattgctgaggtgtacaccatctccgtgaacgtcaagacggggaaggccgagttcaagagggtctacgcgatcagccgccacaagccgaggggcaaggtctacaaggttatcggcaaggacgggacctctatcattgttacggaggatcactcactcttcaactacgacgagaacggcaatctggtttgcgtgaagccgcgccagatgaagcatatcattaggaacttcaacaatccctacgatgtggagtaccggatcggcgactacattgagacaaattaccagaggactgattccaagtacaacagccggcagaatgacattcccgagaagctcaagatcacaaaggagctgtgccagttcctgggcctcttcgtcgcggaggggtcatacatcactaacggcatctccattaccacgaaggacgatgacatcgctaagttcattgagcggttcgtgaaggagcagatcaacgagaatattgccgtcaagcgctacgaggattcggtgcggttcgtcaacaaggggttctaccgcttcctcaaggagcacatcaatggcaaggcgattaacaagaatagcccggagttcatcctgaagggcgacaaggagatgaagctggctttcctcggcgggctgatctcgggcgatggctacgtgtccaaggacggccgcgtgcagatctacacaacttccgagcagctcctggggcagctccatctcctgctcagcgacctgggcatgatctactcgattacaaagatcaaggaggagggcgagaagatcgagattaagcggaacgagatcgtccgcaattacaagctctacgttatcgagattgccaagaactgcaccgaggacctgaagccctacgtgatccccaagtacaagaaggagaggatcaagccagcgaactacgatcagctcccttacgactaccggatcattaaggagcacctgcgcaagatcaccgataagaagccatacaacgactacgcctggaagtccaacaatcgcaagctgaagctcaacacgctggagaagatcgagcagctcaatccacatctgagggaggagattaacaagttcaagctgaatatccctttcgagattaaggagatcaaggagattgactacaacggctacgtctacgatctctcagtggaggataatgagaacttcatcacagctacaggcatcctctgccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3057 - DNA, 5429 bp, Artificial Sequence
  Synthetic Construct, AS-57 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctcccttacgatgagaagatcctcattttcgagaataacgagtacaagctggtcaagatcggggagttcgtggagaagtacctcaaccgctacaaggacagggccatcacctacggcgataacaatatcgaggtgtacattaaggacgagaatatctacgccccatcgttcgacaaggatggcaagatcgtcctgaagcctatcacgcacgcgattcggcatcgcgggaaggagatctacgagattgagctggagtcgggcaagaaggttagggtgaccggggaccactctgtgttcacgatcaacgacaatctggatgtggtcgaggtcaaggctagcgacctcaaggttggcgatttcatcattacaccgaagatcattccctcaatctccaaggacaagatctacctctcggagatcgtcaagaacaaggacaagtactacgttaagatcaaggatcacatcaagttcattgaggagcatgaggagatcctcaaggagtcctacaaggagtacaagactaagtggaaggacctgaagccggttctcaagaagaagaacgcgttccggctcgatctgatcgaggacctggtcgataaggagaagatcgagaagatttcttacggccacgctaactacatcaacaataagattaagctcgacgagaagttcggctacctgatcggggccttcctctcagagggccattggaacgacaagtgcgtggagatttccagcaccaacaaggagttcatcgagaatctggtcgagatcattgaggagattctcggcaaggacgcgtactacatcacagtgaagggggacaagcgcaggtacaaggacctctacgtgatcggcctcaacaagactgtcgctatgatcttcgagtccctcgggctgaacaagctgtcgtctaataaggagatcccgagcattctcctgtcgaatgagacgttcctgaagggcctcatcaaggggtacattgacggcgatgggtcaatctacgtcgacgagtctaagcgggattactcaatccgcctgtacaccacgtccgagacactccgcgacactctctgcctggcgctcaagatcctgggcattaactaccggctctccatcgacaagaagagcaaggttaacgagaattggcgcgattgctacgtgatcaagattaccggcaaggagaacattgagaagctcctggacgtcgagatcaagaacaatggcgggaaggatgttatcccgaagattgccgagaagttcaaggagatcattaaccagtactcccagagggagtggaaggagcggttcggcattgacgtgaacaatctgcatatctgggaggatctcaagaagggctacatgagcaggtaccgggcgaagaaggttctcaacattatgaagaatgtgaaggagatcgaggagaagtacggcaggctcctggacaagatcgggcagctgattgacaacgatctcctgttcgagcgcatcaagagcattagggtgctcgacgagatccccgagtatgtgtacgatatttccgtggagggcacagagaacttcattgggggggagggcttcatttgcctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3058 - DNA, 5186 bp, Artificial Sequence
  Synthetic Construct, AS-58 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggacggggatactacagtgctgctggacggcaagctcatcaagatcaaggatctggaggacaagtggaaggacgtgaaggtcctcacatcggacgatctgaacccgaagctcacttccctgagcaagtactggaagctcaatgctgacgagtacgggaagaagatctacaagattaagaccgagctgggccgggagatcattgcgacggaggatcaccccttctacaccacgaacggccgcaagaggtgcggggagctcaaagtgggcgacgaggtcatcatctacccgaacgatttccccatgttcgaggacgataatagggttattgtggacgaggagaagatcaagaaggtcatcaacaacattggcgggacctacaagaacaagatcattaatgagctgaaggacaggaagctcatcccgctgacgtacaacgatcagaaggctagcattctcgcccggatcgttggccacgtgatgggcgacgggtctctcatcatcaacaacaagaactcccgcgtggtcttccgcggcgacattgaggatctcaagaccatcaaggaggacctcaaggagctgggctacgatggggaggagatcaagctgcatgagggggagaccgagatcacggactacaacggcaagaagcgcatcattaagggcaaggggtacagcttcgaggtgaggaagaagtcgctctgcatcctcctgaaggctctgggctgcgtcggcggggacaagacaaagaagatgtacggcattccaaactggatcaagactgcgcctaagtacatcaagaaggagttcctctcggcttacttcggctctgagctgacaactccgaagatccgcaaccacggcacctcattcaaggagctctccttcaagatcgcgaagattgaggagatcttcgacgaggataggttcattaaggacatcaaggagatgctcaaggagttcggcatcgagctgaaggtcagggttgaggaggggaacctccggaaggatggctacaagacaaaggtctacgtggcctccatctacaaccataaggagttcttcggccggatcgggtacacctacgcgaataagaaggagacgctggcccgctacgcgtacgagtacctcctgacgaaggagaagtacctcaaggaccgcaacatcaagaagctggagaacaatacaaagttcattactttcgataagttcatcaaggagaagtgcctgaagaatggcttcgttaaggagaagattgtcagcatcgaggagaccaaggtcgactacgtttacgatattactactatttcagagactcataacttcattgctaatggcttcctcacgggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3059 - DNA, 5243 bp, Artificial Sequence
  Synthetic Construct, AS-59 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctgccatacgaggagaagattattattaaggagggggagttcattaagccagtggagatcgggaagctcgtggatgagatgattgagcgcttcggcttcgagaagatcgggaactctgaggtctgcgacctcccgatcgatatctacgccctctcactggaccaggatgagaaggtgcactggaagcggatcatttcgtgcatccgccacaagcataatggcaagctgatcaagattaagaccaagagcgggagggagattaccgcgacgccgtaccactcgttcgtcatccggaaggataacaagatcattcccgttaagggctccgagctcaagatcggggacaggattccggtggtcaagcatatccccgcgaattgcgttgaggctatcaacatttccgactacgtgagcggcaattacgttgtggataacatcaacaataagattgccccaaagatcaacggcaagtccattcctaacaatatcaagctcgactacgatttcggctacttcatcgggatctacctcgcggagggcagcgtcaccaagtacttcgttagcatctcgaatgtggacgagctcattctgaacaagatccgggccttcgcggacaagctcggcctgaactacggggagtacgataacaataacggcttcgcggagtcgcatgacatccgcatctactcctccaccctcgctgagttcctgtctaatttcggcacctcgtctaacacgaagaagatcgccgagttcgtgttcggggcgaacaaggagttcgtccggggcctcatcagggggtacttcgacggcgatgggaatgtcaacgccgacaggaaggtcattcgggttacatctaactcaaaggagctcatcgacggcatcgctattctcctggcccgcttcaatatcttcagcattaagacaaagactaagaaccagttcgtgctgatcattccccaccgctacgcgaagaagttccatgaggagatcaatttctcggtcgagaagaagaagtccgagctggagaggctggtgtcatccctgaacgacgataagacatacgactcaatcgatatgattccatccatcggcgatgctctcactaagctgggggagaaggtcgactaccctaaggttatcctcaagaagttcgagcggaagcagaagatcggcagggctaccctccagaggcacctgcgcaggatcgaggagctggctgtgaagaagggcgtcaacatcctcgccctgaaggagtactggctcctgaagaaggccgttgagtccgacgtgatctgggatgagattgtcaagatcgaggagattagctgcgacaagaagtatgtgtacgatatttctgtggaggggctggagactttcactactttcgatggggttctcactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3060 - DNA, 5294 bp, Artificial Sequence
  Synthetic Construct, AS-60 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacatcaaattcaaagatcctgacagacgatggctactacattaagctggagaagctcaaggagaagctggacctgcatattaagatctacaacaccgaggagggcgagaagtccagcaatattctgttcgtgtcggagcgctacgcggatgagaagatcattcggatcaagaccgagtcggggagggtcctggagggctctaaggaccacccggtgctgacgctcaacggctacgtgcccatgggcatgctcaaggagggggacgatgtgatcgtctacccatacgagggcgtggagtacgaggagccttccgacgagatcattctcgatgaggacgatttcgcggagtacgacaagcagatcattaagtacctgaaggataggggcctcctgccgctccggatggacaacaagaatatcggcatcattgctaggctcctggggttcgccttcggcgatgggagcatcgtgaaggagaacggcgacagggagaggctctacgtggccttctacgggaagagggagaccctcatcaagattcgggaggacctggagaagctcggcatcaaggccagccgcatctactcccgcaagcgcgaggtcgagatcaggaacgcgtacggcgacgagtacacatccctgtgcgaggataattctatcaagattacttcaaaggccttcgcgctgttcatgcataagctcgggatgcccatcggcaagaagacggagcagatctacaagattccagagtggatcaagaaggcccctaagtgggttaagcggaacttcctggctggcctcttcggggctgacggctctcgcgcggtcttcaagaactacaccccgctgcccatcaatctcacgatgtcgaagtctgaggagctcaaggagaacatcctggagttcctcaatgagattaagctcctgctcgctgagttcgatatcgagtcaatgatctacgagattaagtccctggacggccgcgttagctacaggctcgccatcgtgggcgaggagtcaattaagaacttcctggggcgcatcaattacgagtactccggcgagaagaaggtcatcgggctgctcgcgtacgagtacctccgcaggaaggacatcgctaaggagattcgcaagaagtgcatcaagagggcgaaggagctgtacaagaagggcgttacagtgagcgagatgctcaagatggatgagttcaggaacgagttcatctcgaagcggctgattgagcgcgctgtctacgagaatctcgacgaggacgatgttcggatctccactaagttcccgaagttcgaggagttcatcgagaagtacggcgtcattggcgggttcgttatcgataagattaaggagatcgaggagatttcatacgactccaagctgtacgacgtgggcatcgtttcaaaggagcataacttcattgctaacagcatcgtggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3061 - DNA, 4835 bp, Artificial Sequence
  Synthetic Construct, AS-61 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcggtggactacaatgagcctattattattaaggagaatggggagattaaggtcgtgaagatcggggagctgattgacaagattattgagaactccgagaatatccgcagggagggcatcctggagattgccaagtgcaaggggatcgaggttattgcgttcaactcgaattacaagttcaagttcatgccagtttcggaggtgtctaggcaccctgtgtctgagatgttcgagatcgtggtcgagggcaacaagaaggtcagggttacacggtcccatagcgtcttcactatccgggacaatgaggttgtgccgatccgcgtggacgagctgaaggtcggggatatcctggttctcgcgaaggagctccccaacatcgaggaggacatcgagattgataagaagttctcaaagatcctgggctacatcattgctgaggggtactacgacgataagaagatcgtgctctcttacgactacaacgagaaggagttcatcaatgagaccattgattacttcaagtcactgaactccgacatcacgatctacagcaaggatctcaatatccagattgaggtgaagaacaagaagatcattaatctcctgaagaagctgcgcgtcaagaacaagaggatcccgagcatcattttcaagtcgccctacgagatcaagaagtctttcatcgacggcattttcaacgggaaggatgctaaggtgttcgtctcaaaggagctcgccgaggacgtgatcttcctcctgctccagattaaggagaacgccacaatcaataagaagtcgatcaacgatattgaggtctacgaggttcggcgcatcaccaacatctacacgaatcggaagctggagaagctcatcaactccgacttcattttcctcaagatcaaggagattaataaggtcgagccgacgagcggctacgcgtacgacctcactgttccaaatgcggagaatttcgttgctggcttcgggggcttcgtgctccacaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3062 - DNA, 5192 bp, Artificial Sequence
  Synthetic Construct, AS-62 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttccatccggatgaggttctcttcattgatcgggggcgggggctggagtgcattactttcaaggagctgttcgagctggaggacaaggacaacgtgaagatcctctccttcgatggcgagaagctcagcctgaagaagctcaagctggcctccaagcgctactacaatgacgatctcatcaccctgcggttcaacctcggccgcgagatcaagattacgaaggaccacccagtggtcattctggaggatggcgagctcaagatcaagctgacatctgacgtgaaggagggggataaggtcatcctgccctacggcaacttcggggaggagagggagatcgagattgacatcctggaggagctgagcaagacagatctcattgagaaagtgtggatccacaacaaggacctggcgactaatgagttcaacatcattaagccatacctctcgaataagtaccctcatgacgtcaagaggaacggcaccatccgggctaaggacattctcccgatcaaggagattctggataagtacgggtccaagaaccggctgttcacggcgaagtcgaagtctaccacgatcccctacaagattaagatcgacaaggatttcgctcggctcattggctactacctgagcgaggggtggatctcgaaggactacggccgcaacggggttgtgcgcaagaggattggcctctgcttcgggatccacgaggaggagtacattaacgacgttaagaatatcctcaacaagctgggcatcaagtacattgagaagatcaaggatgggtcacattccattctcatctccagcaagatcctggcttacgtcttcgagaatattctgaactgcggcatcaactgctacaataagaacatcccgccccagatgttcaatgccaaggaggagatcaagtgggagttcctcaagggcctgttccgcggggacggcgggatcgtcaggctcaacaataacaagaatctgaacatcgagttcgccaccgtttctaagaagatggcgcactcactcctgattctcctgcagctcctgggcatcgtcgcttcggttaagaagtgctacaataacaagtctacaactatggcctacatcattaggattaacggcctggagcaggtcaagaagatcggcgagctgttcgggaagaagtgggagaattacaaggacattgccgagtcatacaagcggaacatcgagccgctcggctacaagaagtccgataatttcgcgatcctggaggttaaggagatcattaaggagcattactccggctacgtgtactcagtggagacagagaactcactgctcattacaagctacggcatcctcattcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3063 - DNA, 5012 bp, Artificial Sequence
  Synthetic Construct, AS-63 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttctattccgggggatgaggtcgtttgggccaaggtggacggggaggccaagctcattcctattgaggatctctacgagctctggaaggagggcagggatgttgaggtggctgctctcacggaggagggggtggtctggtccagcgtcgacagggttgctaggcacaggaggcggacaggcctggtgaagatcattacaaggactgggcgggaggtcatcgttacagaggaccattccgtgttcactgtccgggacggcaagattgtggatgtcccaacctcagagctctccgagggcgattggatcgtcctcccagctaggctgccagctggcgactcagatgagattgacgggatcaagattgacgaggatctcgcgttcctcctgggcctctacgtggctgaggggtccctgaccaaccagaaggacgctgtcaggatccacaataaggatcctgaggtcatcgaggagattgaccgcatcgttagggagaagggctgggaggggcggtactacgagagcgaccattcgtactggatcaagagccggaagctccgccagctgtgcgagaagctcggcactaaggccagggagaagaggctcgggccactcctgtcgctgaagcctgagctcctggctgctgctctgaggggctactacacgggcgacgggtcgttctctgtgaagccgcacggccgctctgccatcattgaggcgaccacggtctcaaagaggctcgctgatgagctcctggtggccctccagattctggacatcgtcgcgcgccgctacgagtgcgacgataccaagggctcgacgcggtaccgcgtgatgattaccaagtctgagtacatccgcacgttcgttgagaaagtgggcttcgcccagtccgagaagaacgagaggatccggaagttcctcgcggagaggaagtggacacgcggcaggtccgatattccgactgagctgatcgggagcccctacacctacgttgaggtggagtacatctctgacagggtggctgctgatggcgggctcatgaaggccgagctggagcatctgtacttcgacaagattaaggagatcgttcccctggatcgcgacgatgagtatgtgtacgacgtcgtggaggttaagctcgggcataatttcgttggggggcagggggttctgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3064 - DNA, 5396 bp, Artificial Sequence
  Synthetic Construct, AS-64 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggcgccggagacaaagatctgcctcgctgacgggcggttcgttagggccgatgagctgttcgaggagctgaaggagcgggggcgcctggttaagtgcgacgagagcgaggaggtgtacgagctgagggagccagttggggtgtccagcctcgacaaggatgcggtggagatcgtcgagggcaagattacgcacgtgtggcgcctcaaggccgacaagctggtcgaggttgaggtgaagaacggcaggtcgatccggaccacgccagagcataagttcctggtcctcgatccttctggcgagatcgttgagaagagggccgatgagctggagatcggggactacattgtgtgcacccagaagctcgtccacgagggcatgtcggaggaggagctcaagagggaggtgttccgcaggctgggcagggacttcttcgtccatctcccggaggaggaggccgagagcgttctggagctcgcgaaggagcggggcatcaaggctctctgggagacgctggaggtggacattgaggagaactcgttctactaccagctcaggaaggggcgcatcagggccgatattctcgtcgacctggctgaggagctgggcctcgacctggctgatctgtacgacgccgtcgaggtttcatacaggtccaataccaagtccacgaagccaatcaggctcccagagccagaggacctcttctacctggcgggcctcatgttcggcgatgggtgctggaaccagctgaccaatggctccgaggccatccagggggaggtgaagcgcattgcgagcgacatgggcctggaggtgcgcgtgcgccgctacgaggggaagacagcccggatcgacttcccagagactgtgcctcgcattctggaggctctcttcgattacccaaggcggaagaaggcccaccggatccgcgtcaacgatttcctcacaagggcgcctctggactgcatcgctgagttcattcggggctacttcgacgcggatggcacagttgaggaggggcggagcgctgtttcggtgacttcggtctctcgcgagttcctggaggatctccagctcctgctccagaagttcgacgtggcttcttacctgagggagggcgatggggcttacaccctctacgtgtccggcgctaggtcactggagaggttcccagggttcagggagccagagaaggctgagaagctgaagaagctcatggagaaggcctcgtcttcagagctggagaaggtcccgatctccggcgagattctcagggaggtcaggggggacgttcccacaactcgcatgttcaactgctactcaaattacgagggcgggcaagtgggcctcaccaagtccagcctggagaaggtcatctccacgctggaggctgtcggcgttgagggggaggctctggagaggctcaaggctctggcgcgggacgatgtgtgcttcctggaggtggtccgcgttgaggaggtggagtacgacggctacgtctacgacttcacagtggaggagcatcataacttcgctgcggagggcttcgtggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3065 - DNA, 4745 bp, Artificial Sequence
  Synthetic Construct, AS-65 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcggtttcggctgatactcctattctcgttaggcgggggggggaggttctgcgggttactttcgaggatctggactcatggtacttcggcgacaggggcggggagtatgtggacgtgtctgacctggaggtcctgaccgttgaccggaacttccgcgtcacgtgggctcgcgttagcaagctgatccggcaccgcgccaggaagattctcagggtgcatctggaggacggcacaatcgagctcactgggaatcacgccgtcatggttctggatgagggcgggctcagggctgtcaaggcttcggagattgaggagggctcattcctcctgtccttcgtggcggagctggacgagcagccaacagatggcgggaccgtggtcacgtccgtcggctcggggtctcgcgtgagcgacaccacgtacgagctgccagtggaggtccgcgttgagctcctgagggagctcgccgacgatggcgtgatcgaggcgagcgaggacgtgtcggtcgatctcgcttggctggcccggatttctggcgtcgagtcacgcgttaccgacgatggggtggagctcgtctgggagacaaggactggcgacctcctgccagctgatccagtgctcaagctggtcgagcggctggagtcggacctggtcgacgacctggagtcttgggtcttcgatggcagggtgtcaaaggaggcggttcggaaggtgctgtccagcgtggacgctaagaacctcaggggggatgctaggagggcttacaggatgctccggaccctggttcgctccgacgtgcatgcggttaaggtggaggacctggatgtcatggactacgatggctacgtgtacgacgtttctgttccaggcaatgagatgttcttcgccggggaggttccagttctgctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3066 - DNA, 5276 bp, Artificial Sequence
  Synthetic Construct, AS-66 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgcgccggggacaaagattctcacggagcatggctgctgggttaaggtggaggatctccctaagatgctgaccgatcagaagctgaaggtttacgacgtggatgagggccgcgaggacgattccgagatcaagttcgtcatggagaggggcattgaggaggacgagagggctgtggtcctcgtgaccgagtcaggcctgacgatcgaggggtccgaggatcacccagtcctcacccctgagggctacgttgagctgggggagattgaggagggcgacctcgttgtggtctacccgttcgagggcgtcgagtacgaggagaaggagggcacgatcctcgacgagtccgatttcgaggacgtggatccccaggtcctcaggtacctggaggagagggacctcatcccactgaggtggagcgatccaaaagtggggacgctcgccaggattctgggcttcgcgatgggcgacgggcacctgggcgagcaggctgggcggctcaccctgtctttctacggcgacgagcgcacgctcagggagctgaagcgcgacctggagtcactgggcgtcaaggcgaacctccatgttcgcaagcgccgctacgagatcgagacagctagcggccgctacgagggggaggctacttcggttgagctgcgggtggcgtcgcgctctttcgctctcctgatggagaagctcggcatgccaagggggcggaaggtggagaccccgtacaaggtccccgattggatcaaggaggcgcctctgtgggtgaagaggaacttcctcgctgggctgttcgctgctgacggctcggttgtgaagttcaagcggtacacaccgctccccatcaatctgactcaggccaaggtcgaggagctggaggagaacctgcgggagttcatgaatgacgtggcgaagctcctgcgcgagttcggcattgagaccacgctgtacgaggtcaagagcaagaagaacgtcgtttacaagctggccatcgtgggcgaggagaatattaagcgcttcctcggcaaggtcgggtacgagtacgatccagagaagaaggtggagggcctcgctgcctacgcgtacctcaagctgaaggagcgcgtcaagaaggacaggaaggaggctgctgagacagctgctgaggtgtacgaggagacaggctccatcactaaggcccatgaggctgtcgctgacgtggtcaacaggaggttcgtggagagggttgtgtacgacggcgggatttccagcgtgcgggtcccagaggatttccctaccttcgagcggttcaaggaggagagggttctcgctggcgggttcgtgatcgaggaggtcgttgaggtcaagggcgttgagccggagtacgacaggttctacgatattggggtttgccacggggctcataacttcattgcggatggggtcgtcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3067 - DNA, 5381 bp, Artificial Sequence
  Synthetic Construct, AS-67 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgcgcctgggacaagggttattacggcctcgggggacgtggtggagattgatgagatcgtggagcgggctgcggagacggctgtggacggcgggctgagggagggctctacagaggttactgtgggggtcaccaacgtcaggacgctggctgcttgggacggcgatctcacctctaatgacgtggtcgcggtggagaagatcgaggctccgtcacgggccgttcgcgtgaggaccaggtccggcgctgagctggttgtgagcgaggaccacaagttcctcgtggacacggaggatggcccaaggatggtcgaggctagcgagctcaagtcgggggatgagctgtactcggtgcgggagctccgcgtgtctgagaaggtcccaacatacctggagctcctgctggaggccgaggacaagttctacgtgcatcctactgaggagttcgaggaggctgtcgctgagcgctacggctccctggctgaggcttgcagggagaaggagctcccatacagggccagggaggctaaggagcgcaggtactacgagctgagcgagttcgctaggctcgctacggctgttatcgagtcggtggacgaggccacagagtacattgattacgtcactgcgggcgggcggaagcgcgttaagttctccagcccaaggccaggcaaggaggtcatgtatgtggcgggcctgatcgcttcagacgggtccgttgatacagagaggggcttcgtgatgttctcaaacactgagcgggagctgctctccgcgttcgaggagattgtcacagaggagttcggcgttgacgcctcgaagaccgagaaccagaatggggtcacgatgctgagggtcaattcccgggttctcgcgcgcgtgttcgagaggctggctgacccgaagactgtcctcaagatgccccgcgagctcgtggctgcttacctggctggctacgtcgacggcgatgggcacctgaaggatgggaagatcgtgattaccacggctgacagggagagggctggcgatctccagctgctcctgaagaggctgggggtgccaagcgtcctcagggagagggacggcgcttacgatgtcgttgtgacagggcacgacgctgctgagctcgctgaggagctcccactgaggcatcctaagaaggctgaggctgctgcttccatgtcgtctggcaggcgctcatccaggttcgaccgggtgagcaggaggttcgggaggctcctgagggaggtgcgcaggaagtacggcgtcagggcttccgatctggggagctcgtctaccatctctcagattgagtcaggcgagaggagggctacgaggaggctcgctctggagatcgtcgagaggctggaggaggtcgttggcgacgttgaggaggtgcgggagctcagggagctggctgagggcaactacgtgctggatgaggtggtcgaggtcgagacggttgagtacgagcatgagtacctctacgatgttacagtggttccagatcatactctcgtggttgagaatggcatcattacaagcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3068 - DNA, 4781 bp, Artificial Sequence
  Synthetic Construct, AS-68 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgctcgtggacaaacgctagggcggttacaaggcgggggttcgtgcatgtggatgatctcactactgatgatgaggtcatgtcggtcgacgatcagggcaggacaatctggcagcagattgacgaggtggtccggttcccgttcagcggcacgctctactcgctgggcgggagggagatcaacgctaccattacggccaatcaccgggttgtgggcctcaaccgcgagaagaccaagtgggttgagcatacaccaacttccctgcctggcaacaagatgtgggtgtacaccgctggcgaggggagcaatgaggactacccgctcaccgatacggagatcaggctcgctgtgtggggcctgacagactcgcacaggtctcccgatggccggtggactttctaccagtccggggagaaggcggagcaggtcaggaagctcctggctgacgctggcattgagtacagggagagggctaggaacaggggcatcaccgagattgatgggaaggtcctcaaggcgccgcccaagacgcagtacgagttctcgctcggcaaggttcaggagctggacgatctcctggacagggggaggagcgagctgccaacatggactctctccctgagccagaggcaggctaggctcttcctggaggagtacaggttcaccgacggcacggataccacgtcagctggggactcctacgtcctctacgtttgcaaggatcgcatgagggagcagctccagatgctggctgctgctaacggcctcagggcttccacaactgagtacaggccagggcattggaggctgaacatctctaatagggcgctctcaggcctgtacaagaataccgtggaggaggtcgcttacgagggggaagtgtggtgcctgcgggttccaaatggcaggttcttcattgaggatgggggcaagattcatctcacgggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3069 - DNA, 4823 bp, Artificial Sequence
  Synthetic Construct, AS-69 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctcgcctgctctactcctattctgactacaaatgggtggtcaactatgggggctctccaggacggggatgaggtctacgcgcctgacggccagcctaccaaggtcatcaaggcccaccccattaacctcaataggccatgcttcaaggtccggttccgcgacggccaggaggtggtcacggatgcggagcatctgtggcaggtgaacgaccggaacaatggcgggagggatcgggtcatgaccacgcaggagatcgctgacgctccatggggcgggcgctacaggttccgggtcccagttaccgagcctctccagacgccagaggctgacctgccagtggatccatggctcctgggcgcttggctcggcgacggggatgcctcgatggtctctatctgctccggcagccaggacctcgattacctgatttctagggtcgagggcctcgggctgtcacacagggttaaccgctacggctcacgcgccgcttccgtctacgtgcatggcatgagggctgtgttctcggagctcgggctcctgaagaataagcacatccccgacaggtacctgaccgcttctgtcgctcagaggaggcagctcctggctggcctgatggacagcgatgggacagtttcggatcgccaagtgactattagcatgaagaacgagaggctcatgaggcaggtgctccagctggtccggtccctgggctacagggctggcttcgggagccgcatggctaggctcaatggcagggactgcgggctggtctacgtggtgcgcttccatacaggctggggggagtcgcccttcgacatgccacgcaagagggatggctgggagcaggcgacaaagacttccgttcagaacctccggctgaatgccatcgttgcggtggagcctgtcgagaccgtcccggttcgctgcattactgttgctcatgagtcttcgctctacgttgctggggaggggttcgttcctacacataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3070 - DNA, 5138 bp, Artificial Sequence
  Synthetic Construct, AS-70 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttaagaatgattcgctgattttcactgatcgggggctggtcactgcggcggagctcgctgtcggggttcctgaggagcatgcggccttcacggaggttggcgtggacacatccactgggagggcgaccacgaacgctgtgtacaatggcgggaggagcccaaccaagagggctaggctcgccctgggctacgagctggaggcgacgccagagcacccaatcagggttctcagggacgatgcgctggcttgggtgcggatggacgagctccatgtcggcgatcgcgttgctctgaggaggggctcggaagtgtgggggcgctccagcctgccagaggcgttcaggtgggtcaagcctaagtacgccgcgaacctcaagctgccaaagggcctcgtgctggacgaggtcgctgctgaggcttgcggcctcctggtctccgaggggaccctcacgaagcgcctggttacagagttcactaacgccgacgcggataatgtgggcttcatctcgcgctgggcggcttctatcggcattgacctctcaaggaacgggagcgattcgattcagtacctcctgtgctccgtggtcctcagggagtggctggcttggctcggcctggactacaccagggccgctgggaagtgcatcccgcgggcggtccgcttcggcgggagggacattatgagggcgttcctcaggggcctgttcgacggggatgcttctgtcgatcccctcaagggcgttatcgagttctgcacagcctcagagaggatggcgcgggaggtccaggttgctctcctgggcctcgggattctggcttctcgccactcaaggactgtggccggctacgagcagctgtactggcgggtgaccgtcaacgacgtggccacgttcgagagggaggtcggcttctcgtctaactggaataggctcaggctgagggaggctgtggcgcgggcagagggcaggtgccggaacccgaatgttgatacagtgcccatcaacgggctcgtcgagaggctgtacaggactgcccagaagcagctctcctggtcatcccaggagggccgcatcttcgggaattacgtgcacggcgagcatgctccaagcagggctgctctggagaggatggtccagcgctgggggtcggagtgcccaaccgagtgcctccctatcgaggccttcctggagctgcctgttgccttcctgtccgtggagagcattgaggacggcgaggcggatgtcgtggatctctcagttccagagacgcatgagttcgttgctaatggggtcgtttgccataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3071 - DNA, 5105 bp, Artificial Sequence
  Synthetic Construct, AS-71 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcccagcctcaacgcggattctcagggcggacactggcgcggagtcaactctcggggagctgctggcctcgggggagcagcctctcgtttggtccctggacgagaggatgaggatggtcgctaggccgatggttaaggtgttcccctcgggcaggaaggaggtgttcaggctgaggctcgcttctgggagggaggtcgaggctaccggcaaccacccgttcctcacggtggacgggtggatcccactggataggctcacagtcggcgacaggctggctactccaaggagcgtgccagagcccgtccacacagagaggatggccgatgcggaggtggtcctcctggctcacatgatcggcgacgggtcgtgcgtccgcaggcagcccgttcgctacgcctccattgacgagcagaatctcgctgcggtgagcgaggctgctgagcatttcggcgtgacggcggtcagggacgattacgctgctgcccgcgtcaccacgctgaggctcccagctccttacaggctgtcacgcggcaagaggaacccaattgcggcttggctcgatgagctgggcctcttcgggctgaggtcccacgagaagttcatcccacggcgcgtcttcgctctccctaatgaccaggttgccctgttcctccgccatctgtgggccacagatggctccgtgaggtgggacagcacttacaggcaggcgcgcgtctactacacatccactagcaggcggctcatcgacgatgtggcgcagctcctgctcaggctgggcgttcacgggcgcattcgcagggtgaccaagccagggtacagggacgcttggcatctcaccatcgacggcgctgataaccagacggtgttcctgagggatgtcggcgttcacggggcccggggcgacgctgctcaggtggctctggctgagctggagccactggtccggaacaccaatgttgacacggtgcctaacgaggtttggaatcaggtgcgccacctgctcgcgacaaagaacattactcatcgcgagttctcggctgccatggggtctaggttctgcggctcaaccatgtggaagaggtcgccctctcgctcaaggctcgcccgcgtcgctgctgttctggacgatgcggatatcgagatgtacgctaccaatgacgtgttctgggataagatcgtcgagattacgtctctcggcgagcaggacgtgtacgatggcactgttccaggcactcataacttcgttgctcagtctatctctgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3072 - DNA, 4769 bp, Artificial Sequence
  Synthetic Construct, AS-72 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttccctgcgggcacagtcgtttcggggccatcggcggaggcggctacaaggcgctggttcgagggggagctggtcgttttcactaccgctagcgggaagcagctctcgctgaccggcaaccacccagtgctcacgcgcggcgggtgggtccccgccaacctcctgaatgagggcgacgaggtggtcaggtcgacaaggccacagggcgctactccactcgttgtgcctgaccaccatcaggtgccggcgctgatcgaggatgtctgggggagcttcgctgttaatggcctccacagggtgccagctgctcctgaggacttccatggggatggccagaggggggaggtcgacatcgttggcccagatcggaccctgtggtgcggccacgacgctgctattgctcagcagcgggagcagcagttcttcacccgcaggacggagtccagcggcctcctggtggctgagtccgtcgctcagctcgttgacctgtggcaggctccacactctggctcgtctatcgggcgctcaggcctcccattcgctctgattggcgggcatggcgggggccctgtcgagaggggcctcacggttgctgctgggggctacccaggcctccatgaggccctggcggactaccggcccggcgatgctgtgctgccaccacagggggtcttcgctggctcatccgagatcgggggcgacgattgcgtgattggcaaggtcgactccacacgctgggatgctccagctctccccttcctggtggaggggagggcgggctacgctagcagggggaaggagctcttcgaccggctgactggccaggtcgagctcgatcgcatcgttattctgcggcgcgtgcagtggtccggccacgtcttctcgctcacaagctcagaggggtggcatacgggcaactcgctcatcgtctctaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3073 - DNA, 5057 bp, Artificial Sequence
  Synthetic Construct, AS-73 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttccctgcgggcacaccagtggacactatcgatgggccaaagcctattgagtcgctgcgggctggggatcgggttctctcgcatgacggctcgtacgccacggtggagaagctgatcgagaacacaaatgatcagccactcgtctccattagccacttcggccataaggagcctatcaggtgcacgccggagcaccccattctggtgtggacggaccgggatgtcgagacactcatcgacggcgatggggctgacccgttcaacggcttcgtgtggctggctgctcaggacgtccatccatccgatttcattgttgctactgctccactggagacccgcgagaggagggtgttcgacctcatgaatcacgtcggcgaggggacgtacgaggaggttgacggcctgatccggaaggtgaacacagatgcgaggcatcggaataagcagcgccacaggcagggcttcgtcgctgttacccgctacgtggaggagagctacgacctcggcctgatcctcgggtggtacctcgccgagggccatgtctcgaagcgctctggggttgaggatgtgaggccaacgggcgtgcatttcacactgggggctaacgagattgagaggcacgtcgagctcggcatggccttcaagcaggtcttcggcgttgacctggtgctccacactaaccattcagatcactccaccaggatggtttgcaattctaagatcgtggctagcctcctgctctcgctggctggcacggggtactcaacaaagcggctcgcgcacgaggtcatgaccgctgacgaggatttccagaggggcctgctcgtcgggctcttccgcggcgacgggtgcaccacgacaggcgggatggtcctggacctcgttaaccaggagctgatcgatcaggtccagctgctcctgaggaggctcggcattgttagcgtggtccgcacgtacacaaaccaggctggcaatccgactgggcaggtgttcgtcccaggcctgcctgggaccaacgaggagttcatcttcgacgtggataagaacctccagaattacactggcaggaaggggaccaagcggactacctaccaggttgtgcatggccgccacgtctacgggattcgggctgttgagaggactggcgagaccccaaggcaggtctacaatctgcatgtggagggcactcatacttacactattaggggggctgtggttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3074 - DNA, 4847 bp, Artificial Sequence
  Synthetic Construct, AS-74 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggacggggacacaagcgttactctcgcctcgggggatgagaagcctattcgggacatcgtggagtcaacactggaggatccgacagagatcagcgacggcttctaccaggagtcggacattgatgtgctcaccacggatggcggggctgtcgctccaggcagggctaccaaggtttggaagcggcaggctcccgagaagatgtacaggatccggacagagtccggcagggagctggaggtcactccaagccaccccctgttcgtgcagtcagagggcgggctctccccactggtcgctgacgatctcagcgagaacgacttcgtggctgtcccgagggcgctgccagctgacgatggcgacgatttcgggcagcatgtggacgatctgggctccgtcaccgctcggaagacggctgacgctgaggccgtgcgctccgaggacgccgcgacaactccagatgttatccctaacgtgggcgaccagctccgcaggattcgcacctcgctcaggctgtctcagcacgactgcggcctgccaaggtcgacgtaccagcagtacgagaggggggaccggaatccttcgcgctctaggctccagacagtcctgactgcgttcgagcggcgcatcgagcagctctccagcctgtctgacagggtggacgatggcgactcagatgccattgctgccgcgcgggacgagctcaatccatcacaggcttccctggctagcggcatggatgctaccaggacggctatcggggacgatgagaggacggaggctaggccagacggcggggcggttgctgatgctgagagggctgtggctgacgctctctgcagggcgctggctgtcgccgacgatgttgagaggctcaggtcgctggctgacggcgatatcgggtgggacaggatcgattctattgagccagtcgagcctgaggacgagtgggtttacgatctggaggtggagagcacacactcatacctctctaatgatgttgtttcgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3075 - DNA, 5306 bp, Artificial Sequence
  Synthetic Construct, AS-75 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcaattcctgcggatgagcaggtcgtggttaggcgcaatggggagacggagctgacggagatcggccctctcgtggattcgctgatggattctcgcgagaccaggtcattcgacgatcacgaggtcacgctcgctccagacggcatcgaggttccctctctgtccagcgaggagaccgttgagtggaagccgattgaggaggtgtcacgccacgagacgccagacgagctcctgaggttcgagctggagtcgggcaggtctatcagggctaccaaggctcattctttcgtcacgcgccaggagaacgaggtggtcccagttgctggggaggagctggaggctggcgactggctccctgttgtggcttcgctggacgccaccgatacgcaggagacagtggacctgaggaagtacctcccggcgggcgattactggtacacttccgtgctcgccgacggcggggctgaggctgtcccaggcgggcccgaccagctgaggaacaagagggctgctctggaggctggcgagctcgctgagcacacagcttacccagtgcagggcactgtcgggctcccagagcagttccctctggacgaggagaccgggttcttcgtgggcgcttggctggctgagggcagcctcgcggatcattacgtttccatcagcaatgtggacgctgccttccagagccgcattaggtcgttcgccgagcgcttcgatctcacggtcaacgagtacgagaatgactccgggttcgcggctggctacgatatccggctgaacggcaccattctgagcgacttcctcagggctgcttgcacggacgatggcgagaagtcgatccccgggttcgctattggcgccaatgaggcgttcctcaaggggctcctgcagggctacttctccggcgatgggaacgtgggcaccaatgcgatcaggtcgtcttcaacaagcgacaggctgactgctggcgttgggctcctgctcgctaggttcgatgtgtacgccacactcggccagcaggaggactcacgcactctgagggtcccaaagaagcacgtttcccggttcgacaaccgcatcggcatggtcggggagaggggcgctgagctggaggctctcgctgagtcagctgactccgatgggccagacgctacagatcagatccctaacttcggcgatgctctggaggctgtggctgaggctgctgacatcccacagaggcaggtcaattcggccacgaagcggcagcgcattgacaggtctcggctggctaggctcgtggctgctgctgaggccgagctggacggggagcagtccgagctggatgcgctcaggcaggctgtcacaggcgacgtcgtttgggatcggatcgagtccattgagactgtggagagcgaccatgagtatgtgtacgatgtttcagtggaggggctggagactttcacaactgcggatggggtcgttactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3076 - DNA, 4796 bp, Artificial Sequence
  Synthetic Construct, AS-76 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcatcggggatactctcattccgctcgctgacggcaagtcttaccgcatcaaggatctcatggactgggggacggagttcatcgtttacgcgtgcaccccaacgggcaagattgtggctgctcaggctaccgctaagctcacgaggaggaacgctccactcgtgaaggtcatcctggacaatggcgaggagatcatttgcacacccgaccaccagttcatgctgcgggatgggacttacaaggaggcccagctcctgcaggcggagacatcactcatgccattctactccaagactgacaaggatggctacacactgattactcagccttactccagcaggtggcagaaggctcactggatcattgctaggtctggcctcctggggaaggtgccaaggttcgagggccagaagacgttcatccaccatcagaacttcgacgagagcgataaccgccccgagaacctggagttcatgggcaacagggaccactcggcgtaccatcgctctctggtggagaggaatcagcactggcattccgctgagttcgaggagaagagggtcgctagcctcgctcagaaggctaagacctcggagggctaccagtactacgccgagagggggacgcggaacatcttccagtacatggagcagcagccagagcacttcaagaatgcggtcgctggcaacgggaataggggcaagcagtacctcgttgagtacaacaagacagagaagggcagggggaagtcgcaggagatcgcgaaccggtactacacctgcgagatttgcggcgtcgacgttaagacgcccatcgggctgcacaaccatcggcgcaaggagcaccagtgcaatcataaggtggtcgccgtgaacctcctgaattacaccgaggatgtctactgcctcactgttccggagtaccacaacttcgctctcaaggctggggtcttcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3077 - DNA, 4886 bp, Artificial Sequence
  Synthetic Construct, AS-77 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctgctctcgctctggataccgctctccctacgccttcggggtggactactatgggggacgttcaggttggggatcagctctacgatgcgcacggcaggccaaccacggtggtcgctgctaccgaggtgctcacggggaggccttgctacgaggtcgagttctcagacggctcccgcatcgttgccgatgcgcagcatcagtggctgaccgagtctagggctgctcggaagtcacgctgggctgctgacaagcagtacaaccgcgccaggaaccagaatatcgtcgcgagcgttgtgacaactgaggctattgctgggaccctcagggtgggcgctgaccagagggccaatcacgctgtcctcacggctgatccactgtccggcagcgacgtcgatctgccaatcccaccctacgttctcggcgcttggctgggcgacgggcactcggcgtctgctaggatcacctgcgagacgccagagattcctatgtacctggaggcttgcgggctgagggtcgaccatcagggcgcgatgctctactccctgaagttcccagacggcgatccgaggggcagcgtccagggcgttctcaggaccatcggcgtgctgaacgacaagcacattccagcggattacctcagggcttccgagggccagaggagggacctcctggctgggctgatggacacagatggcactgtcgttaggggcgttgggtcgtgccagttcgctgtgacaaacaagcggctcgcggacgatgtctacgagctcgtggtctctctggggtacaagtgcggcaggaccacgaggagggtgcagggcaggagcccagagacatcgacttgccatatcctcaatttctcgacggtggacgatgtcttcaggctggagcggaagcacctcctgcataaggaggagaggccagtgacacgggctaggatcgccaggcggtacattactgccgttcgcccaattgagtccgttcctgtgaggtgcgtggaggttgataatacagagcatctctacctcgccggggagagcatgattccaactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3078 - DNA, 5051 bp, Artificial Sequence
  Synthetic Construct, AS-78 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctccctgaggatgcgctggttcataccgctaaggggctggtccctattcgggatgttcaggtcggggatctcgttcagacaccgctcggcttccgcagggtggtcgacaagttcgatcagggcttccaggacgtgtacgagatcgagactaacgcgacctacccacgcgctacgctcaatcacaggcaggctgtcctggaggacgctaagggcgggatcgtttggaagcatattgcttcgctggaggccggcgataggctcctgcacaacaagcaggtcctcccgggcactgttacccatctgcccgcggacttcactgagagcaggccatcacactcccggaccgccaagtcgttcgttgtgcctgagctcacggctgaggtggcttggctgatcggcttcacacatggcgacggctacgtggctctcggcaggaacaagtacgataagccgtacgggcgggttgagtggtccatgaactccctggacgctgaggtcacctcccgcatccaggctaagattgatgctgctctcgctctgttcggcctctccgctgtccacagcatcacgaagggcgagaacacagctaagagcatctgctccagcattcggctggccgagtacttccaccgccatatcaagcagccaaatattcctctcactgtgccgtcattcatcctgcagggctccgtcgacattagggctgcttacctcgctggcctgatggactccgatggggctgtgaacaataggccaccacacctcatcacatcggtgtaccggtctttcattcgccaggtctcggtcgttctctcgtctctgggcatcgccgggaggctgaccacgacatacccccagaactctaattggcaggtcaagtacaacctcacgatcccggcgctgaaggagcgctacaatgctctcatttctccccattcagccaagggcgagctcaggcaggggctgaagatgtacggcttcacggttccaggggccgtgatgcgggagacgtacacatactctgagatgagggagatgggcttccaggggtcacggacagttgacgccaactacgagcgctacgtggcggaggctgacatctccctcgatattcctgtgactgtcaagggcctggggagctacgatcacgtgcagacctacgacattgaggttgatgaggctcattgcttctactgcgatggctacctcacacataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3079 - DNA, 4322 bp, Artificial Sequence
  Synthetic Construct, AS-79 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggattacgagactgaggtcgtgctggggaatggggagcggaagaagatcggggagatcgtggagcgggctattgaggaggctgagaagaacggcaagctcgggcgggttgacgatggcttctacgctccgatcgacattgaggtctactcgctcgatctggagaccctcaaggttcggaaggcgcgggcaaatatcgcgtggaagcgcacagctccaaagaagatgatgctggtgaagactaggggcgggaagcgcattagggtcaccccgacgcaccccttcttcgttctggaggagggcaaggtggctatgaggaaggcccgggacctggaggagggcaacaagatcgccacgattgaggggctctccgtgagctgggacgaggtcgcggagatcctggagtacgagccaaaggatccttgggtctacgatctgcaggttccaggctaccacaacttcctcgctaatggcatcttcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3080 - DNA, 4634 bp, Artificial Sequence
  Synthetic Construct, AS-80 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtcgcgcctgagacactgattattactgagaatgggacaaaggagatcggggaggtcgtggagcggtggatgaaggagctgggcgagatcgagtacgacgatggcatttcgtactctccggccttcgagaaggttgcgtccctgaacggcgggaaggtgaagatgctcccggtccgcagggtttggaagctgaggagcccaggcaagatgatcaagattcgctcagagtccgggaagcagatcaccgtcacgccagagacaaagctcctgactatcattgacggctcgctggagtgggtggaggctcgcaagctgaagaaggggaactacgttgcggtggtcaataaggagaggagcatcgtgcctattggcgacttcctcgctaagctcctgaagttctacggggtcgagctgaacctcaatgaggctgttgagcgcgaccaggccaggaagctcctggagaccctgaagtctaagggcctctcagatgtcacgatcgagattccagagaagctccggcgcttcatcaagtgcgaccgcgtgcgctacgtggatctggttgagatgctctccagcatggagggcgagctgaaggaggaggtcatgctcctgctctccgacgtgggggatatccacgaggtcattcaggagcggctgaaggagatcggcaagattctggagagcgacgcgtcgtgggagaggatcgctgaggtggaggaggttgtgcgggatggccatgtctacgatctcacagtggagggctctcattctttcattgctaatggcttcgtggttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3081 - DNA, 5012 bp, Artificial Sequence
  Synthetic Construct, AS-81 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcctccctgatgagaaggtcgtggttccctcggtcgggttcgtgacactcaaggagctgttcgagacggcttccaaggtcgtggagcgcgacgatgagaaggagatcagggagctcgacgagcggattaccagcgttaacggcgatgggaagacgggcctggtcaaggcctcctacgtgtggaaggttaggcacaagggcaaggtcatccgggtcaagctcaagaattggcacggcgttacagtgactccggagcatcccttcctcaccacgaaggggtggaagagggctgaccagctgaggccaggcgattacgtcgcggttcctaggttcatccatggcaacgaggacgagaagattttcctctcctacgtgaaggtcaagaagtctggcgaggagtggaaggagtacttctacctggcgggcaggaaggggaacatcgatgtcaatctcctgttcgttgctccaaagcgctacgtggtcgagttcctccgggggtacttcgaggagcgctccgaggtcaagggcgagagcgttatcgtggaggctcgggagctggtggagcctctcagcctggctctcctgaggttcggcatcttctctaagattcaggggtcaaagctcatcgtcaccggcaagcgcaacctggaggccttcaaggactacattggcttcaaggatgagagggagaaggccctggaggaggcgatcgagaaggtgaagggctccgaggtctacccgatcttcgaggagattcgcaggctccgcctcctgttcgggttcacaagggaggagctgggctcatacgctaagtacgagaactccgaggccccgacttacgaggagctcatggagatcctggacttcattgagagggggtcccccagcctctcgaagaagatcgcgattctggagggcaagctgaaggctgagctcagggtgctggaggaggagggcctgatcaaggacgggaagctcaccccactgggcagggagctcctggaggtctggcggaaccgcgagttcgattccaaggacgtcgattacatccggaacattgcggagacgctggtgttcatccccgttgagaatgtggaggaggaggagtacgacggctacgtttacgatctcactacggagactcataacttcattgctaatggcatcctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3082 - DNA, 4418 bp, Artificial Sequence
  Synthetic Construct, AS-82 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctgcgctctactacttctctgagattcagctccctaacggcaaggagttcatcggcaagctcgtggatgagctgttcgagaagtaccatgacaagatcggcaagtacaaggatatggagtatgtggagctcaacgaggaggacacattcgaggtcatctcaattgggccagatctgtccgctaggaggcacaaagtgactcatgtctggcggcgcaaggttaaggacggcgagaagctcgtgaagatcaggaccgctagcgggaaggagctcgtgctgacgcaggaccacccggttttcgtgctcctgggcagggacgtcgctaggagggatgctggcaacgtcaaggttggggacgagattgcggtgctcaatacgcggcccgatttctcggtcctgtctccgcccgctatgccagagctcctgtctgagcctttcaattacgagctgtccagcatcggcgacgtcgcttgggatgaggtggtcgaggttgacgagattgatgccaagggcctcggggtggagtacctgtacgatctcacagtggatatcaatcataactacgttgctaatggcattgtcgtttctaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3083 - DNA, 4829 bp, Artificial Sequence
  Synthetic Construct, AS-83 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcagcggggaggagacagtcgttattcgggagaatggggaggtcaaggtgctcaggctcaaggatttcgtggagaaggctctggagaagccaagcggcgaggggctggacggcgatgtgaaggtggtctaccacgacttccgcaacgagaatgtcgaggttctcaccaaggatggcttcacgaagctcctgtacgctaacaagaggatcgggaagcagaagctccgcagggttgtgaatctggagaaggactactggttcgctctcacccccgaccataaggtctacaccacggatggcctgaaggaggccggggagatcacagagaaggacgagctcatctctgtcccaattactgttttcgattgcgaggacgaggatctgaagaagatcggcctcctgcctctcacctcggacgatgagcggctgcgcaagatcgccacgctcatgggcattctgttcaacggcgggtctatcgacgagggcctcggggtgctcacactgaagtccgagaggagcgttatcgagaagttcgtgattaccctcaaggagctgttcggcaagttcgagtacgagatcattaaggaggagaacacaatcctgaagactagggacccgcggatcattaagttcctcgtcggcctgggggctccaattgagggcaaggatctcaagatgccatggtgggttaagctgaagccttcactcttcctggccttcctggagggcttccgggctcacatcgtggagcagctggtcgacgatccgaacaagaatctccccttcttccaggagctgtcctggtacctcggcctgttcgggatcaaggcggacattaaggttgaggaagtgggcgacaagcataagatcattttcgatgctgggcgcctcgacgtcgataagcagttcatcgagacgtgggaggacgtggaggtcacctacaacctcactacggagaagggcaatctgctcgccaatgggctcttcgttaagaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3084 - DNA, 5195 bp, Artificial Sequence
  Synthetic Construct, AS-84 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcccccctactgaggaggcggttttcaagttcggggataaggttaagatcgctactttcgaggaggtcgctaagaatttcaagttcgagcacaaggtcgagatcgacggcttcaagggggagtacagcattcccaacgacctctacgtgctgaccttcaatgatggcaaggccgagtggacccgggtcacgaagttcctccgcaggaagcacgaggggaagatccgcgtcattaagaccaagacgggcaggacgatcaggaccacgccagagcataagttcttcgtttacaaggacggggagctggtgaagaagagggctgacgagctggagccaggcgatgagctggtgctcctgtggcggttcgagtccgaggagacactcactgagatcaacctcctggaggctttcaaggacctgccacaggaggagaaggagaaggtctacgttcgggggattaaggacctcgatctgacgcctctcaaggagaagtacggcgacaaggtctactactgggcgaggcaggattcgatgccgctctctgtgttctacgagctcaacgtcgacctggataaggagttcaggctgggccgggacgctacaacttacgagctcccatctaagctgaagatcacaccttcactcgccaagctgattggctacttcgtgtcagacgggaactactccgacaaggatctccgcatcactgtgggccacgaggatgtcgagaaggagatcgttaatattctggaggagctcggcctgccatactcgttcctggagtgggaggggaagaccaagcagatcgttattggctctcgcctcctgaggctggtcttcaagcatgttttcaagatcccagagggggctccaaacaagaggctcccggagggcttcctgtccttccccttcgaggctaaggtggctctcctgagcggcctcttcaatggcgacggctacgtggtgcgcggcgagcaccatctgtcgatcgggtacgcgtccacaagcaagggcctcatcagggatattctgtacctcctggcttccctgggcattttcgcccgggtgtaccgcgtccctaaggagaagatgaagggggccaaccacgacctctacaagctgtacatcgcgggcaccgatctcgttcgcctggtggagctcctggagctcagggagggccatcgggagaagctgggcgagatcgggaatcgcaagccggcgagggtgaagaagatcgctgacttctacattgacgttgtggatgaggtcagcgaggaggagtactcgggctacgtttacgatctggaggtggagaatgaggggcatagcttcgttgctgcggatggcatcctcgtttcaaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3085 - DNA, 4385 bp, Artificial Sequence
  Synthetic Construct, AS-85 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcccaggcgatacacgcattctcgttcagattgacggggttcctcagaagattactctcagggagctctacgagctgttcgaggatgagcgctacgagaacatggtttacgtgcgcaagaagccgaagagggagatcaaggtgtacagcattgacctggagacaggcaaggtggtcctgactgacatcgaggatgtcattaaggccccagcgacggaccacctcatcaggttcgagctggaggatgggcggtctttcgagaccacggtggaccatcctgtcctcgtttacgagaacggccggttcatcgagaagcgcgctttcgaggtcaaggagggggacaaggtgctggtctcagagctggagctggttgagcagtccagctcgtctcaggataatccgaagaacgagaatctcggctccccagagcacgaccagctcctggagatcaagaacatcaagtatgtgcgcgcgaatgacgatttcgtgttctcgctcaatgctaagaagtaccacaacgtcatcatcaatgagaacatcgttacacatcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3086 - DNA, 5327 bp, Artificial Sequence
  Synthetic Construct, AS-86 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacgggggacgctaaggttatcgctaatggggagctgacaacgatcggggagctggtggagcgcatctcaaatggcaagctgggcccaacccccgtccggggcctcacggttctggggatcgacgaggatggcaagctcgtggagctgccagtcgagtatgtgtacaaggacaagaccagcgagctggtcaagatcaggacgaggctcggcagggagctgaaggttaccccataccaccctctcctggtgaaccgcaggaatgggaagatcgagtgggtgaaggctgaggagctgaagccaggcgacaggctcgctattccgtccttcctccccgccatgctgaacgataatcctctcgctgagtggctgggctacttcttcggcaacgggtacacagacagcgaggagcgcgtggtcttcgagtctaagtcaaaggagctcaggaagcggttcatggagctcactaggaagctgttccaggacgccgagatcaaggaggattccggcaaggtttacgtgtccagctcggaggttaagcgcctcgtgaagtcactgaacaaggattccatcccagagcaggcttggaaggggctcaggagcttcctgagggcgtacttcgactgcaatgctgagatcaaggataagatcattgtgtctacggctggcaaggagatcgccgagcagatttcatacgctctcgctggcctggggatcgtggctgaggtcgacgataaggggtcggtcatcatttctgacccggagaacgtttctaggttcctggatgagatcggcttctcagtcgaggagaagaaggaggaggctaaggccctgattaagaagtcgaccctcaacctgggcatctacgtggacaaggagctcatttcctacgtccgggagaagctcaagctgagcttctacgagaatgagacgatgtggtcgccagagaaggcccgcgagatcgcgtggaagctgatgaaggagatctactaccggctcgacgagctggagcgcttcaagaaggcgctctccaagagcgtgatcattgattggtcggaggtcgagaagaagaaggaggagatcagcgagaagacagggatctcggtgaacgagattctggagtacgccaagggcaagaggaagccgtctctggaggagtatgtgaagatcgcgaaggctctcggcgtggagctgaaggagacactggaggcgattttcactttcgggaagaagtacctgggctacgtgatctccgacgagattgagaccctggaggaggtcaggaaggaggagctcaagcggctgaaggagctcctgaacgacgagaagctgaagaagggggtcgcctacctcatcttcctggcgcagaatgagctcctgtgggatgagatcattgaggtcgagaagctcaagggcgacttcgttatctacgatctgcatgttccaaagtaccacaacttcatcgggggcaatctgccaactgttctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3087 - DNA, 5654 bp, Artificial Sequence
  Synthetic Construct, AS-87 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacaggggacacaaaggtctacacgcctgatgagcgggaggttaagattagggatttcatgaattacttcgagaatgggctgatcaaggaggtgtctaatcgcatcgggagggacacagtcattgccgcggtttccttcaacagccgcatcgtgggccacccagtctacaggctcactctggagtccgggaggatcattgaggccactggcgaccacatgttcctcacccctgaggggtggaagcagacgtacgatatcaaggagggcagcgaggtcctcgttaagccaaccctggagggcacgccttacgagccagaccccagggtcatcattgatatcaaggagttctacaacttcctggagaagatcgagcgcgagcacaacctcaagccactgaaggaggcgaagacgttcagggagctcatcacaaaggacaaggagaagattctgaggagggctctggagctgagggctgagatcgagaacggcctgaccaagcgggaggcggagatcctggagctgatttctgctgatacgtggatccctcgcgctgagctggagaagaaggccaggatctcaaggacccggctgaatcagattctccagcggctggagaagaaggggtacatcgagcggcgcattgagggccgcaagcagttcgtgcggaagatccgcaatggcaagattctccggaacgccatggacatcaagcgcattctggaggaggagttcggcatcaagatttcatacaccacggtcaagaagctcctgtccgggaacgttgatggcatggcgtaccgcatcctcaaggaggtcaaggagaagtggctggttcgctacgacgatgagaaggcggggatcctggctagggtggtcggcttcattctcggcgacgggcacctggctaggaatggccggatctggttcaactccagcaaggaggagctggagatgctggctaacgacctccggaagctcggcctgaagccgtcggagatcattgagcgcgattcgtcttcagagatccaggggcggaaggtgaagggccgcatctacatgctctacgtggacaatgctgccttccatgccctcctgaggttctggaaggtggaggtcgggaacaagaccaagaagggctacacggttccggagtggatcaagaagggcaatctcttcgtcaagagggagttcctcaggggcctgttcggggctgacggcaccaagccctgcgggaagcgctacaacttcaatggcatcaagctggagattcgggctaagaaggagtccctggagcgcacggtggagttcctgaacgacgtcgccgatctcctgagggagttcgacgttgattcgaagatcacagtgtctccgactaaggagggcttcatcattaggctcatcgtgacacccaacgacgccaattacctcaacttcctgacacgggtggggtacgcctacgcgaaggatacttacgccaggctcgtcggcgagtacatccggattaagctcgcgtacaagaacatcattctgcccggcatcgctgagaaggccattgagctggcgacagtcactaacagcacgtacgcggctaaggttctcggcgtgtcgagggacttcgttgtgaatcggctgaaggggacacagatcggcattactagggatttcatgaccttcgaggagttcatgaaggagcgggtgctgaacggctacgtgatcgagaaggtcatcaagaaggagaagctcggctacctggacgtctacgacgttacttgcgctcgggatcatagcttcatttccaatgggctcgtttctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3088 - DNA, 5027 bp, Artificial Sequence
  Synthetic Construct, AS-88 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcatcgatggcaacgctaagattattttcgagaatgagggggaggagcatctgacaactatggctgagatgtacgagcgctaccgccacctcggcgagttctacgacgagaactacaatcgctgggggattgatgtgtccagcgtcccgatctacgtgaagtccttcgacccagagacgaggagggtggtcaagggcagggtccgggccatctggaagtacgagctgggcgaggagattccgaagtacgagatccgcacacacaagggcactaagattctcaccagcccatggcatcctttcttcgtcctgacaccagacttcgaggttatcgagaagagggcggacgagctcaaagtgggcgatatcctgattggcgggatgcctgacggggaggatcacgagctcattttcgactactggctggctggcttcatcgctggcaacgggaatctcgacgattcggagagggagtacaaggcccgcgagctcctggatggcatcgagaacgggattccgcccaagatcctgaggaagggcaagaatgccgtcctctctttcatcacgggcctgttcgacgctgaggggcacgttaacgataagtcaggcattgagctcgggatggtgaataagaagctgatcgaggctgtcacacattacctcaacagcctgggcatcaaggcccgcatgagggagaagcggcgcaagaatggcatcgactacattatgcacgtggaggagtactcgtctctcctgcggttctacgagctcattggcaagcatctgcagaacaatgagaagaaggagaagctggagatcctcctgcacaagcataacggcggggcgttcgatctctcactgaacttcaatgctttcaaggagtgggcctccaggtacggcgtcgagttcaagaccaacgggaatcagatcctcgctatcattggcaacgagaaggttagcctgggccagtggcacgcgagggggcatgtgtcgaaggctgtcctggttaagatgctccggaagctgtacgaggttactaagaacgacgaggtgaaggagatgctccacctgatcgagtccctggaggttgtgaaggagatcaccattacgaacgagcccaagaccttctacgatctgacagtggataagtaccagaactacctcgccggggagaatggcatgattttcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3089 - DNA, 5144 bp, Artificial Sequence
  Synthetic Construct, AS-89 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcacaggggacactcgcatcctgacggagaaggggctgattcctattgaggagatcgtgcatgagacgggcaagaagccaaaggtggtcacacacgctggcctcaaggacatcattgagacttacgataacggggagatggaggttttccgcgtgaccacggaggacggctacgagctcaaggtgaccggggaccataagttcctggtcttcgatgagaacggcaatccaacgctcaagcctctgaaggagctcaaagtgggggactacgtctacatcctggctccagagtggaagggcggggagtatgtggagctcgatacaaacatcgagctgaagggcaaggggtacaacgttaatctgccctcgaagctcgacgagaagctggcgtacctcctgggcatcatctacgctgatgggcacatccgccattacttcgagaacggcaagcgcaagaactccaagatcgagatctacctccaccaggacgagaccgagatcaaggagaaggtgaagaggtacttcaaggagatcttcggcattgagccaaaggagttcctcaaggaggagcagcataaggtcatcctggttattccttccacgaagattgtcaagttcctggagatcaacggcctcctgaaggacaagagcgagaatattcgggttccggaggctatcttccgctcccgcccatctgtgatcgctgcgttcctggctggcttcttcgacggcgatgggtcgatcgatcagaactaccggatcgccttcaagtccattagccgcgagttcatcaaggaggctcagctcctgttcctcgccctgggcatcgtgacatccattcaggagtacaacccgcccaatccaaacaataagacagtttacactctccgggtgcagactcgcgacatgaagatcaaggcgttcaacgtcctcaaggagagcgttaagctgtcgaagattatgaaggaggctatctctaagctggaggagaacggcaagaataagaagttctcattcccgttcaacgccatctaccacattaaggaccccaagatcagggcgaagattcagcgggattacaagatcctctcatacaattccaaggtgacccatagggccttcatcaacaatattctcaagctgaaggaggagctcggcctggacgatgaggaggtcaagtacttcgagatgctgagcaagctctacccaaccaagatcacgaagattgagcctctggggaaggcgcacgtctacgatctccaggttgaggatgttcatctgctcacaggcaatggcatctacacaagcaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3090 - DNA, 4976 bp, Artificial Sequence
  Synthetic Construct, AS-90 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggtcggggagacaaggattctgacgcctgagggctacatcaaggctgaggagctgttcaagctcgccaaggagcggggcaagatggaggccatcgctgtggagggcattgctgagggcggggagccatacgcgtactctctggagatcctcctgcctggcgacaagcaggtcaagtacgagaccgttcacgggaacgctgtggaggtcgccgatccggtttcagtgcccgcctacgtgtggaaggtcggcatgaaggaggttgcccgcgtgaggacaaaggagggctacgagatcaccgccacgctcgaccataagctgatgactccggagggctggaaggagatcaaggacctgaagccaggggataagattctcctgcctaggttcgaggtggaggaggacttcggctccgagagcatcggggaggatctcgcgttcgtcctgggctggttcattggcgacgggtacctcaacgttaaggataagcgggcgtggttctacttcaatgctgagaaggaggaggagatcgcctggaagatccgcgagattctggctaagaggttcgagatcaaggccgagccacaccgctacggcaaccagattaagctcggcgtcagggggaaggcgtacgagtggctggagtccatcgttaagaccaacgagaagaggatcccggagattgtgtaccggctcaagcccaatgagattgcctcattcctcaggggcctgttctccgctgacggctacgtggacaatgatatggctatccgcctcacgtcgaagtctcgggagctcctgcgcgaggtccaggatctcctgctcctgttcggcatcctgtccaagatctacgagaggccgtacaagcgggagttcaagtacaccacgaaggacggcgaggagcgcacatacacaactgaggggtactacgagctcgtgatcgcgaactactcccggaagatcttcgctgagcgcattggcctggaggggtacaagatggagaagctcagcctggagaagatcaaggtcgacgagcccattgtcaccgttgagtcggtggagatcctcggcaagaagctggtctacgacttcactgttccagagcatcacatgtacatttccaatgggttcatgagccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3091 - DNA, 5138 bp, Artificial Sequence
  Synthetic Construct, AS-91 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgcgcctgggtcaaaggtcctcacggagcatggctactggctgaaggtggaggagctgccggagaagttcaagctgcagggcgttaaggtgtacaacctggacgagggccacaacgatacaagcaatgttgctttcgtggctgagagggaggtggagactggcgagatggccgtccgcgttaccacggagtccggcaggatcattgaggggagcgaggaccatccagtcctgacccctgagggctacgtttacctcgggaacctgaaggagggcaatctcgtgattgtctacccgttcgagggggttgagtacgaggagaggaagggcgtgatcctcgacgaggatgcgttcaaggacgaggatccccaggtgctctccttcctgagggagaagggcctcgtcccactgcgctgggacgatccccgcatcgggacaattgctcggatcctgggcttcgctttcggcgacgggtacctcggggagatgggcgggaggctcacactgactttctacggcaaggaggagacgctccgggagctgaagaaggacctggagcgcctgggcatttcggccaacctctacgtgcgcgagtctatcgagacaactagcggccactcggaggggaagtccctcagcatcgagctgcgcgtcacatcgaggtctttcgcgctcttcctggagaagctcggcatgccgagggggaagaagactgagaaggcgtacagggtgccaggctggatcctggaggctcctctgtgggtcaagaggaacttcctcgctgggctgttcgctgctgacggctcgattgtcgagttcaagggcaacaccccgctccccatcaatctgacgcagtcaaagtccgacgagctcgccgagaatctggtggagttcctcggggatgtcgccaagctcctggcggagttcggcatcgagaccacgctgtacgaggttaagtccaagaagggggtgacctaccgcctctctattgtcggcgaggactcaatcaggacgttcgttgagcggatcaattacgagtacgatcccgagaagaaggtgaagggcctgattgctgccgcgtacctcaagctgaaggagaggatcgtgaaggaggcgcatgaggctgtcaaggacgatttcccaaccttcgaggagttcgctaaggagaggggctacgagggcgggttcgtcgctgagaaggtggtcaaggtcgagagggttaagcctgagtacacgaagttctacgatattggggtttaccatgaggctcacaacttcattgctaatggcatcgtcgttcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3092 - DNA, 5117 bp, Artificial Sequence
  Synthetic Construct, AS-92 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggacggggacactctcgtgctgacaaaggagttcgggctcatcaagatcaaggacctctacaagattctggacggcaaggggaagaagacagtgaacggcaatgaggagtggacagagctggagaggccaatcactctgtacggctacaaggacgggaagatcgtcgagattaaggctacccacgtttacaagggcttctccgccgggatgatcgagattcggacccgcacgggccgcaagattaaggtcacgcccatccataagctcttcacaggcagggttactaagaatgggctggagatccgggaggtcatggccaaggacctcaagaagggcgatcggatcattgtggcgaagaagattgatggcggggagcgcgtgaagctgaacatccgcgtcgagcagaagaggggcaagaagatccggattccggacgtcctcgatgagaagctggccgagttcctcggctacctgatcgctgacgggaccctcaagccaaggacggtggccatctacaacaatgatgagtctctcctgcgcagggctaacgagctcgccaatgagctgttcaacattgagggcaagatcgtcaaggggcgcacagttaaggcgctcctgatccactcaaaggctctcgtggagttcttctccaagctgggcgtcccgcgcaacaagaaggccaggacttggaaggtcccgaaggagctcctgatctcagagcccgaggtggtcaaggcgttcattaaggcttacatcatgtgcgacggctactacgatgagaacaagggggagatcgagattgtgaccgctagcgaggaggctgcttacggcttctcgtacctcctggctaagctggggatctacgccatcattcgcgagaagatcattggcgacaaggtctactacagggttgtgatttccggcgagagcaacctggagaagctggggatcgagagggttggccgggggtacacgtcgtacgatatcgtcccagttgaggtggaggagctctacaacgctctgggcaggccttacgctgagctgaagagggcgggcatcgagattcataattacctctcgggggagaacatgtcttacgagatgttcaggaagttcgcgaagttcgtcggcatggaggagatcgctgagaaccacctcacccatgttctgttcgacgagatcgtggagattcggtacatctccgagggccaggaggtgtacgacgttactacggagactcataatttcattgggggcaacatgcctactctgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3093 - DNA, 5777 bp, Artificial Sequence
  Synthetic Construct, AS-93 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctctcgccagatactatggttcgcactactaacggggacaagccaatcagggacatcgcggtcggggatcagctcttcgatcacgaggacaggccagtgcagtgcctcgctgctgaggctatccagacctcccggatgatgaaggttacctacacgggctacaacagcgtgtcgaagtccagcttcacatgcactccagaccacatcatgaccctcgttgcgtacggggtgaagcctttccgccattctaactcaaatagggtgacctggtggacgaggtgcgacaggacggagctgggcgctgatgctgtcgagatcaagtgggatgctgccatgcacgacctctacacagagtaccgcgagcagctgggcaggaggccaactgacgctgaggtccggaagtacctcaaggctatcaccagcacgcgcgtggtcccagattcggaggacgatgactctcagagggtcgaggagacgtaccagtcgcccgttctcattaagctcctggcgaagctgaaggctatggatgtggacgtcgatggcgaggacgagtctgttgtgctcatgctcctgcagcagcacatggaggactacctggagcacatgatcccagagcctgaggatatttccgacgaggataacgatgacctcatcattgacctggatacaaataggaagcggaagatcggcacaatttctactctgtcgtctcgcatctcagacaagactttcaggcagtccccgagcattaagtcatcccccgtgaactctcagcagcagtcacagaatgaggcttcgcagtctaccgtcccgacgtacgcctcggttctcaccgaggatgaccaccgcgagatgttcgcgccagtgcggtcaaagctggctgtccgcgaccctaagtgcaagtgccagaacctctcctgcaagggcctgaggcgcgtcagcacagttttcgagacttcggagcaggctgacctggctctggagctcctgagcggggatcactaccgcgtcgttgacccatgcgccgtgcaggatatggaggtcttcacaatgactctggaggagtaccaggctacctgcacggctcctatgacgcagcataagtccaagctgcgcctctacaggagcccgctcaggttccagccataccagggctcagtgtccccagtcccaatcgacccgttctggttcgggttctggctgggcaacgggaccaagaacaattccgagattacaagcactgatcccgaggttgaggtgtacacgcaggcgctcgtggataggctgaatagggactcgatcccaccaggcaaggctccactgaaggtctctaagtacaagatcgacattggcaccaagcacgtgtacaagggggaggagatcaagaccacgaaggtcgcccatcgcctcagggtcatgagcaccgtttcgaacctggacaagacgcactggaatccagtgcatgatggcctgagggagctcggcctcctgggggacaagtccggcgggatccctgactgctacatgaacgcggatgagaatacaaggctggctgtgctcgccggcctgattgagtcagacggctggctctcccacgggctgaactgctacggcttcgggcagtacacctacgagctcaagaagctggtcgaggacgctcggaagctggctctctcctgcggcatccagtgcaaccccattttcgagaggaagaatggcaaggatcggccagagcctgggtggttcttctacatgggcaggggggtcgagaagttccagccacatctcctgctccctcggaagcgcatgaccatcccgttcacaactagcaagaacagggacgttcggccattcgacgtggaggatgctggcgacggggagttcaggctcattgaggtttcaggggagctcttccagctcgcggataggactgtggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3094 - DNA, 5549 bp, Artificial Sequence
  Synthetic Construct, AS-94 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgctaaggggacactgctgctgcgctacgatgggacaaaggtggaggtggagaatgttcgggagggggatctgctgctgggcccagacggcgggcctaggagggcgttcaacattgtgggcgggagggaccggctctacaggatcaagatggagggcgggaaggaggatctggtggtcaccccaaatcacatcctggtcctccatcgcgagaagagggacggcgtcgataaggtttacgctaggccattcgctctcccactcctgcaggaggacgccaccgacgatggcgaggatctgtcggagatctctgcgattgagcacttcgacaccatggagatcacggctgctgacttcgcttccctcgatccgaacgagcgcaagctgtacaggctcttcacgagcccaggctacgagctgaatgggaggccagtgcccattgacccgtacttcctgggcctctggctgggggatcgctccaggaccaagtccagcatctacacgaaccacgaggaggagatccgggagttcattgcggaccatgctgccgagctcgatctgcagctcgtgtcatacgtctccaatcgcccatccctcgcggctatgaagaacggcaatcagctgcctctcaggcaccaggctaggcagacgatcaggaagcagcgcattgccgcgaagagcatcacacagccaggcggggctaggtcgtcttcataccctgccaccaacggcgggctgtccagcaatacagtgactagcctccactcgcgggagcgccatccactgtccgagtcgtctgctgccgcgacgatgaacctcctgccacgctccacaagcgtctcgacttctgttgctgcccagcctaagtcatccatgagcacattcatcactgacgctattctcccttcggagagctcgaacatctctgtcatttcagattccggcatcgagattagcaagtcttcaaagatgctgtcggaggaggaggccgacctggatctcttcgacattgattcggaggacgaggagatcgaggacctcgatgagaagaagaacgttagcaatgtggacgagttcccgaagcggcgcaggatccactacctgaggaccggctgccggacgtacggggagctctgcccaggcgaggaggaccagatcctggaggatattgttggcaggccagacgggaccacgtctgtggagtcactcctgctcgctctggaggctctggggctccatacctgcggcacgaacgacagcgggtcggataagaagcggatcccctcagtgtacatgaagaactcccgcgccgtgcgcctggctctgctcgctggcctcatcgactctggcgggtggtatgtggattcagagaacacattcggcttcagccagactgaggactctaattcaaccctgatctgggatgttgtgaccctggctaggagcctcggcttctccgtcagcacaaagcggcgcatgactcacaagccgaccaggacgcagcataaggcgcaggagttcgctcagatttcgggcaacgtcgcggagatcccatctctgctcgctagggagaggggcgttgagaggccaatctcccaggcgcacagcttcaagatcaaggacattcagctggagacagaggccactgagtgggcggggttcagggtggatcaggatcagctctacctcaggcatgacttcctcgttctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3095 - DNA, 4313 bp, Artificial Sequence
  Synthetic Construct, AS-95 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgctaaggggacaaggctgctgcgctacgatgggacagagatcaacgtggaggacgtgcgggagggggatcagctgctcgggccagacggcgagccaaggagggcgttcaacatcgtttccggcattgaccggctctaccgcgtgaagatcggcggggagaaggaggatctcgtggtcaccccgaaccacattctggtgttctacagggagggcccatccgatgggcctgagaatgcggagcggcagacagtcgagatcactgccgcggagttcgctaccctcagcacggaggagcgctccctgtacagcgcgttcacctcgccagctgtcgagaagggcgctgaggggtcagctgctcagatgcattccttcaaggttgaggacatttcgctggagtctgagaagacggagtgggccggcttcagggtggataaggatcagctctacctcaggcatgattacctcgttctgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3096 - DNA, 4931 bp, Artificial Sequence
  Synthetic Construct, AS-96 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtcgcgccagattcgctcgtggtcgtcaatgataaggttcaggagatcggcaagctgacagaggagtgggggcgggaggtcgggttcctggagtactccagcggcatcttctacgctccgtacctcggcagggggatttcactggacctcgttacagggaaggtgaagccgtctgtggtctcaaaagtgtggaagctgaagtcccccgaggagctcgtcaccatcaagaccattacgggcaaggagatcacagtgactccagagaccaagctcctgacgttcaacgggacactggagtggaaggaggcgggcaagatcaagcctggggattacgtgctgactgtcaagaagctccacatcaatggcaagcaggagaccctggacgagaagctcgcctacaagagggggctgagcctctcggatccactggagttcttctcctcctccgagaggactatctccgcgtacctgaagggcattttcgacaaggtcggcaggctcgttggggataccgccgttatcaaggtggacaaggatatggcgaagaggctgcagatcctcctgctcaggctcggcattgtctccagcgttgacgagacgggcaaggtcatcatcgggcgcgagtacatccagaagattctgggctacaacgtttccgttgtgacgcacgaggtcgagctcttcagggagttcatcgccgagatttccaagttctacggcacaagcgaggaggacgtctactcgtctctgcatgagaagggcgagctcgatatcgggactgtcccagttgagctgcctgagggcctccgggaggagatcaatcgcgagagggctacgtacagcgagctggtgaagatcgcccaggagattaaggacgagaagctgtacaacaagctcgcgtggatcctgtcggaggtcacggaggaggaggctaagattaaggagaaagtgaatacactcaaggtcatcctgtcatccgatctcattccggagcgcgtggagtcggtcaagatcattaagtctccgtacccctacgtgtacgatctcacagtggagggctctcattctttcattgctaatggcttcgtggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3097 - DNA, 4991 bp, Artificial Sequence
  Synthetic Construct, AS-97 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgctgccggaggagaaggtcgtgctgcctgagatcgggctggttacgctgcgggagctgttcgagctggctaatgaggtcgttgtcaaggacgaggagaaggaggttcggaagctgggcaagatgctcacaggggttgatgagcgcggcaacgtgaagctcctgaatgccctctacgtgtggagggtcgcgcacaagggcgagatgatccgggttaaggtgaacgggtggtactccgtcaccgttacgccggagcatcccttcctgacgaatagggggtgggtgaaggctggcgagctcaaggagggggactacatcgctattccgcgcagggtctacggcaacgaggatctgatgaagttctcgaagatcgccaaggagctcggcattaagggggacgagaaggagttctacctggccggcgcgtctctcgatatcccgattaaggtgctcttcctggctccctccaagctggtcagcgccttcctccgcggctacttcgacgcgaagggggtggtcagggagaactacatcgaggttccactgttcgaggatctccctctcctgctcctgaggttcggcatcgtctcgcggattgagaagtctaccctcaagatctcaggcaagcgcaacctggagctgttcaggaagcacgtggggttcacggactccgagaaggctaaggccctcgatgagctgatctccaaggccaaggagagcgagaggtacccaattctggaggagctgaggaggctcggcctcctgttcgggttcacacggaacgagctgcgcatcgaggagaatccaacttacgaggtgctgatggagatcctggagcgcattgagaggggctcacctaacctggcggagaagatcgctgtcctggagggccggattaaggaggagaactacctgcgcatcctggaggaggagggcctcattgagaatgggaagctgaccgagctcggcaaggagctcctggaggtctggaggaaccgggagttcgactcgaaggacgttgattacgtgaggaacatcgtggagaatctggtcttcctccccgtcgagaaggttgagcggatcgagtacgagggctacgtctacgacgttactacggagactcataatttcgttgctaatggcatcctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3098 - DNA, 5396 bp, Artificial Sequence
  Synthetic Construct, AS-98 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctgctctctacgatttctcggttattcagctctctaatgggcggttcgttctcatcggggatctcgtggaggagctgttcaagaagtacgccgagaagatcaagacctacaaggacctggagtacattgagctgaacgaggaggataggttcgaggtggtctcagtctccccggacctcaaggcgaataagcacgttgtgtctcgggtgtggaggaggaaggtccgcgagggggagaagctgatccgcattaagaccaggacgggcaacgagatcattctcacacgcaatcatcccctgttcgccttcagcaacggggatgtcgttaggaaggaggctgagaagctcaaagtgggcgacagggttgccgtgatgatgcggccgccctcaccacctcagactaaggcggtggtcgacccagctatctacgttaagatttccgattactacctggtgccaaacggcaaggggatgatcaaggtccctaatgacggcattccgcccgagaaggcccagtacctcctgtctgtgaactcataccccgttaagctcgtgagggaggtcgatgagaagctcagctacctggctggggtcatcctgggcgacgggtacatttccagcaatggctactacatctcggcgaccttcgacgatgaggcgtacatggacgctttcgtctccgttgtgagcgatttcatcccaaactacgtgccttccattaggaagaatggggactacacaatcgtcactgttggctctaagattttcgccgagatgctctcacggatcttcggcattccgcgcgggaggaagtccatgtgggacatccccgatgtcgttctcagcaacgacgatctgatgcgctacttcatcgccggcctcttcgacgcggatggctacgtggacgagaatggcccgagcatcgtgctggtcaccaagtcggagacggtcgccaggaagatctggtatgtgctccagcggctgggcatcatttcgacggtttctcgggtgaagtcgcgcggcttcaaggagggggagctcttccgggttatcatttctggcgtggaggatctcgctaagttcgccaagttcatcccactgaggcactcccggaagcgcgctaagctcatggagatcctgcgcacaaagaagccttacaggggcaggcgcacttacagggtcccaatctcgtctgacatgattgctccactgaggcagatgctcgggctgaccgtggctgagctctcaaagctggcctcctactacgcgggcgagaaggtcagcgagtcgctcatccgccatattgagaaggggagggtgaaggagatcaggaggtcgacgctgaagggcatcgctctcgctctgcagcagattgctaaggatgtgggcaacgaggaggcttgggtcagggctaagaggctccagctgatcgctgagggcgacgtctactgggatgaggtggtcagcgtcgaggaggttgacccgaaggagctgggcatcgagtatgtgtacgatctcacagtggaggatgatcataactacgttgctaatggcattctcgtttctaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3099 - DNA, 5033 bp, Artificial Sequence
  Synthetic Construct, AS-99 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttctcgggggaggaggttattctcattgagaaggacggggagaagaaggttttcaagctgcgggagttcgtggacgggctgctgaaggaggcttctggcgaggggatggacggctcaatccgggtggtctacaaggatctccagggcgagaacatcaagattctcaccaaggatgggctggtgaagctcctctacgtgaaccgcagggaggggaagcagaagctcaggaagatcgttaatctggagaaggactactggctcgccctgaccccggagcacaaggtctacacgatcaagggcctgaaggaggcgggggagattaccaaggacgatgagatcattcgcgtcccgctcacgatcctggacggcttcgatgttgcggagaagtccattagggaggagctggagaggctgagcctcctgcccctcaactcagaggattccaggctggagaagatcgcgggcattatgggggctctcttcggctcgggcgggatcgacgagaacctcaatacactgtctttcgtgtccagcgagaagaagactatcgagcagttcgtcaaggctctcagcgagctgttcggcgagttcgactacaagatcgaggagaaggagaactccatcatcttccgcacctgcgataagcggatcgtgacattcttcgctactctgggcgccccagttggggacaagtcaaaggtgaagctcaagctgccatggtgggtcaagctcaagccttccctcttcctggccttcatggacggcctgtactcgtctaaccgcaatgataaggagatcctggagattacccagctgacggacaacgtggagacattcttcgaggagatcagctggtacctctcgttcttcggcattaaggccgaggcggaggaggacgaggagaaggataagtacagggctcggctcactctgtcatccagcatcgacaacatgctgaatttcattgagttcatcccgatttcgttctctcccgccaagagggagaagttcttcaaggagatcgagaagtacctggagtactccattcccgagaagacggaggacctgaagaagcgcgtcaagagggttaagaagggcgagcggcgcaacttcctggagtcctgggaggaggttgaggtgacctacaatgttactacggagacaggcaatctgctcgctaatgggctcttcgttaagaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3100 - DNA, 5405 bp, Artificial Sequence
  Synthetic Construct, AS-100 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcacaggggacactaaggttatcgctaatgggcagctgttcgagctgggggagctggtggagaagctctcgggcgggcggttcggcccaacgccagtgaagggcctcaaggtcctggggatcgacgaggatggcaagctccgcgagttcgaggttcagtatgtgtacaaggaccgcaccgataggctgatcaagattaagacgcagctgggccgggagctcaaggtgacaccataccaccctctcctggtcaaccgcgagaatggcgagatcaagtggattaaggccgaggagctgaagccaggggacaagctcgcgatcccgtcgttcctccccctgattaccggcgagaaccctctggctgagtggctggggtacttcatgggctctgggtacgcttacccatcgaactctgtgatcaccttcacgaatgaggaccctctcatccgccagaggttcatggagctgaccgagaagctcttcccggacgcgaagatccgggagcgcattcatgctgatggcacgcccgaggtctacgtggtctccaggaaggcttggagcctcgttaactcaatctccctcaccctgattccacgggagggctggaaggggatccggtcgttcctgcgcgcctactctgactgcaatggccggatcgagtcagatgctattgtgctctccacggacaacaatgatatggcccagcagatcgcctacgcgctggcttcgttcgggatcattgcgaagatggacggcgaggatgtcatcattagcgggtcggacaacatcgagaggttcctcaatgagattggcttctctacacagtcaaagctgaaggaggcccagaagctcatcaggaagactaacgtgcggtctgacggcctgaagatcaattacgagctcatttcatacgttaaggacaggctccggctgaacgtgaatgataagcgcaacctgagctacaggaatgcgaaggagctgtcgtgggagctcatgaaggagatctactaccggctggaggagctggagcgcctcaagaaggtcctgtccgagccgatcctcattgactggaacgaggtcgccaagaagagcgatgaggttatcgagaaggccaagattcgcgcggagaagctcctggagtacatcaagggcgagaggaagccctccttcaaggagtacatcgagattgccaaggttctggggatcaacgtggagaggacaatcgaggctatgaagattttcgccaagaggtactccagctacgcggagatcggccggaagctggggacttggaacttcaatgtgaagacaatcctggagtccgacactgtcgataacgttgagatcctggagaagatccgcaagattgagctggagctgatcgaggagattctgagcgacgggaagctcaaggagggcatcgcgtacctgattttcctcttccagaacgagctctactgggatgagatcaccgaggtcaaggagctgaggggcgacttcatcatctacgatctgcacgttccaggctaccacaacttcattgcgggcaacatgccaacagtcgttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3101 - DNA, 4949 bp, Artificial Sequence
  Synthetic Construct, AS-101 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgcatcctgacactctcattctcacatcacagggggttcgcaagatcaaggagctctcgcgggagggggaggttttcgctctcgacttcaacctgaagctctccaaggcgaagtacaggctcctggagcgggacgctgatgagcagatgtacaaggtgaccctcctggacggcacggagctgtacctcacagccgatcacccagtgctcgtctacagggagggcaatctggctttcgttcctgccgacaagctccgggagacggatcatgtggtcctggtgctcaacaagtctgctcgggacaattacggcttcctcgatctcctgctggagattactgactcacaggaggattacgccatcctggagaacggcgagaccctgtcgctccactctctgaagatgctcgtggagcgcggggagatcaaggacattgcggttgtgggcttctcgcataacaatttcgggaaggtcatgctcagggatgagctgtggtacctcatcggctacctggctgggaagggcggggagatcaagggcaacggggtcgttatttccagcaggacgaaggagatcgtcggcctgacaaagagcctcaacatcgacctgattgagaccgaggaggggatcgtgctctcaaataagtccttcgtccggctgctccacctgatccattacacgccgcgcgtccccgaggtttacggcatcattaacaatacagagtggctcaaggccttcctggcgggctactacgacgccactctgctggaggggctgaccctggaggctctctacaagatcaaggtctacctgcagctgctcggcatccgcgcgaagattgaggacaacaagctcaaggttcacctggaggatctccagcggttccgcgagctgctcggcaagttcagccgccgcaagctctacgtggagacttcgcaggttccggtgttcaccgacttcgatgagcgctcctacgacttcccaaggatcctgggcggggatatctacatcattggcatcaagagcattgagaagttccattacaaggggaaggtctacgatctcgtcgtggagaactaccacaacttcattgctaatggcattgctgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3102 - DNA, 4610 bp, Artificial Sequence
  Synthetic Construct, AS-102 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtcgcgcctgatactctcattaacacagacaacgggcgggtggagatcggcaagttcgtggaggagtggatgaaggaggtcggggagatttcggaggagggcatctcttacgccccgtgcttccgcaaggtcgagaccttcaaggacgggaagattgttgagagcccaatccgcagggtgtggaagctccgggctcctaagaagctggtgcgcattaagacagagaacggccgcagcatcgccctcacaagggagactaagctcctgactatcaatgatggcgagctgtcgtgggtcgaggctggggaggtgaaggtcggcacctacgttgggacggtgaagtcagagaaggacgtgattccaggcgctgggaagaccatcagggatgtctccaagctctacaacatggagatggaggtcaaggactacctgacgagggaggaggttcggaaggcgattgagaagctggaggagatcatgaacccgatgaatatcaagattcccggcgtgcaggagtcctacgaggagctcctgcggaagctggagaccacgaacgatgagcgggttcgcaatgagacactcatcctcctgtccgacgtgagcgatgcccacgagctggcgaaggagaagatcgagaagattaaggagatcgtgaactccgaggtccattgggagaaggtcaccgaggttggcgaggtggacggggtcgagtatgtgtacgatctcacagtggagggctctcataatttcgttgctaatggcttcatcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3103 - DNA, 5162 bp, Artificial Sequence
  Synthetic Construct, AS-103 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgctgccggaggagcgggttattctgcctgactacgggcctattactctggaggagctcttcaatatgacaaaggagacagtgttcaaggacgaggagaaggaggtccggaagctcggcatccgcatgccagtggctggcgtcgatgggcgggtgcgcctgctggagggcccctacgtttggaaggtgcgctacaaggggaagatgctcagggtcaagctgaaggactggcacagcgtggctgtcacaccagagcatcccttcctcaccacgcggggctgggtgcgcgctgaccagctgaagcccggggattacgttgccgtgccaaagatcctccctgggaaggacgataaggagaagttcctccagtatgtgcacgagaagctgaagggcaaggttcatattaagctgccgtccagcgacgaggagtgggagacattcttctacttcgccggcactatcttcgggcgcgagaactcggtgaatccagagggcctcacccacgaggtcaaggctctcctggagctcttcaaggttctgttcgagtacccgagggaggtcctccgggttctgttcatggccccggtgcgctacgtggcgaacttcctccgcggcttcttcgacattaacggctacgtcaatggggaggagctgagggtcgaggttaggggggctccacatgaggttctggaggagctctccctgatcctcctgaggctgggcatcgtgtccaagatctaccctacgagcctggctatttcgggcaggaggaacctggagctgttccggcgctacatcgggttctcggagaagcagaaggccaaggagctggagggcatcattaggcggtctgagaactcagagtcctacccaattttcgaggagctgcgcaggatcaggctcctgttcggcttcacccgggcggagctctcgtctacgatcccactgtactctaagtacgagtcaaaggaggctccttcatacgagatcctcatgaagattctgaatacaatcgagaaggggtctaaggacctcaacaagaagatcactattctggagggcagggtgcgggatcacgagtacattgaggagttcaagcgcgagggcctgatcaaggacgggaagctcaccgagctgggcaaggagctcctggaggtctggcgcaacagggagttcgactccagggatgtcaactacctccggaatatcattgagaacttcgttttcctgccggtggagaagatcgaggagttcgagtacgatggctacgtctacgacgttactacagagactcataatttcattgctaatggcatcctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3104 - DNA, 5255 bp, Artificial Sequence
  Synthetic Construct, AS-104 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtttcgggggactctaaggtcctgacggagaaggggccagtggagattcggcatctcaattcgggcatgatcgtgggcatcaatggcttcaagagcaggttcgtcaagttccaggagctgcaccaggtcaagtaccaggagtacggggttaagatccggacccagctcggcttcgaggtgaagtgcaccagggagcatcggttcctcacgattgacaagaacggcgagctgcgctgggttgaggcttggaggctcaaggagggcgattacgtggggatcattcgcaagctgccgtctcccaactcaaaggttctcatcctggacttcctcccggagtcgacgtacctctggctgaataaggagttcctcaagaagctgaaggtctctatcaaggagaagttcgggtcaattaagaactacgccaaggagcggggcttcaattccagctacctggtgaagcagctcaacgggctgtccccattccgctggggcaggctcagggttatcctgaatgatgtgtcgatcgagatttctcgggacgatatcgagcgcattacatcacgcaggggcaagtactccctcccaccagagctgactcctggcatcgctaggctcctggggttctggatggctagcggctcgctcaaccgcaataccctgatcttctactcgcaggacaagaagattctggagcgctacgaggatctgtgcaagcgcgagttcagggtcaaggggcggatcaaggcccaggacaagggcacgtacatcctggagattccctcgtctctcctgtctttcgtcttcaagaacctcgcgcgcccaaagctggaggttccaccgatcatctacatcctgcctgagaagcacaaggaggagttcctcgctggctacttcgacggcaacgggttcatcaagattgagaatgggaggatccattccctcggcttcttcgccttcaaccgcaagttcgcggaggggatcagggatattctcctgcagctcggcatcctgtcatccattaatgagcagacattcgaggtgagcatcattgagggcgagaagttcctgaagatcgtcaactcctggcgcagcaattactacaaggagtgggaggacgtgatcccgaacctggagaagaggctgaaggagattgaggagaagctcggctaccccgggacttacaatcggcgcgagatcaggcggtccgagctcaaggcgatcattaagctgtacgagaaggtggctcgggagaggggcctgaacgacgtcctcaaggagctgagctacctcaaggagctgtcggagggcgacatcttcttcgataggatcaccagcattgagccagtgtacctcgatgtcgcgtacggcatcatcaactcagagacaggcaactacgtggttaatggcttcgtttcaaagaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3105 - DNA, 5252 bp, Artificial Sequence
  Synthetic Construct, AS-105 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttctcaggggaggaggttattatcgtggagaagggcaaggaccgcaaggtcgttaagctgcgggagttcgtggaggacgctctcaaggagccatccggcgaggggatggacggcgatatcaaggtgacatacaaggacctgcgcggcgaggatgtcaggattctcactaaggacgggttcgtgaagctcctctacgtgaacaagcgcgagggcaagcagaagctcaggaagatcgtcaatctggacaaggattactggctcgccgttacacctgaccacaaggtgttcacttctgagggcctgaaggaggcgggggagatcacggagaaggacgagatcattagggtcccactcgttatcctggatggccctaagattgcctcaacatacggcgaggacgggaagttcgacgattacatccgctggaagaagtactacgagaagactggcaacgggtacaagcgcgccgcgaaggagctgaatatcaaggagagcaccctcaggtggtggacgcagggcgctaagccaaactcgctgaagatgatcgaggagctggagaagctgaatctcctgcctctgacctctgaggactcacggctggagaaggtcgccatcattctcggcgcgctgttctcagacgggaacatcgatcgcaacttcaataccctctccttcatctccagcgagcggaaggccattgagcgcttcgtggagacgctcaaggagctgttcggcgagttcaactacgagatcagggataatcatgagtccctcggcaagagcattctgttccggacctgggaccgcaggatcattcgcttcttcgtcgcgctgggcgctccggttgggaacaagacgaaggtgaagctggagctgccgtggtggatcaagctgaagccctcgctcttcctggccttcatggacggcctctactcgggcgatgggtctgtcccaaggttcgctcgctacgaggagggcatcaagttcaacgggaccttcgagattgctcagctgacggacgatgtggagaagaagctccccttcttcgaggagatcgcttggtacctctccttcttcggcattaaggccaaggttagggtggacaagacaggggataagtacaaggttcggctgatcttctcacagtccattgacaacgtgctcaatttcctggagttcatcccgattagcctctcgcccgctaagagggagaagttcctgcgggaggtcgagtcctacctcgctgctgttccagagtcgtctctggctggcaggatcgaggagctcagggagcacttcaaccggatcaagaagggcgagcggcgcagcttcattgagacctgggaggtggtcaatgtgacctacaatgttactacggagacaggcaatctgctcgctaatgggctcttcgttaagaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3106 - DNA, 5210 bp, Artificial Sequence
  Synthetic Construct, AS-106 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttctatcctccctgatgagtggctgcctatcgtggagaatgagaaggttcggttcgttaagatcggggatttcattgatcgggagatcgaggagaacgccgagcgcgttaagagggacggcgagaccgagatcctggaggtgaaggatctcaaggccctgtccttcaatcgcgagacgaagaagagcgagctcaagaaggtcaaggcgctgatccgccacaggtactccggcaaggtgtacagcattaagctcaagtcggggcgcaggatcaagattacctcaggccattccctgttcagcgtcaagaacggcaagctcgttaaggtgcggggggacgagctcaagccaggcgatctggtggtcgttccaggccgcctcaagctgcctgagtcgaagcaggtgctcaacctggtcgagctcctgctcaagctgccagaggaggagacgtctaacatcgtcatgatgattcctgttaaggggcgcaagaatttcttcaagggcatgctcaagacactgtactggatcttcggcgagggggagaggccaaggactgctggcaggtacctcaagcacctggagaggctcggctacgtgaagctcaagaggaggggctgcgaggttctcgactgggagtccctgaagaggtaccggaagctgtacgagacactcatcaagaacctgaagtacaacggcaatagccgcgcttacatggtggagttcaattctctcagggacgtggtctcactgatgccgatcgaggagctcaaggagtggatcattggcgagccgagggggccaaagatcggcactttcattgatgtcgacgattcgttcgcgaagctgctcgggtactacatctccagcggcgacgtggagaaggatagggtcaagttccactccaaggaccagaacgtgctggaggatatcgccaagctcgcggagaagctgttcgggaaggtgaggaggggcagggggtacattgaggtcagcggcaagatctcgcatgctattttcagggtcctcgctgaggggaagcggatcccggagttcattttcaccagccccatggacatcaaggtggcgttcctgaagggcctcaacgggaatgctgaggagctgaccttctcgacgaagtctgagctgctcgtcaaccagctcatcctgctcctcaactccattggggtgtcagatatcaagattgagcatgagaagggcgtctacagggtttacatcaacaagaaggagtcgtctaatggcgacatcgttctggattcagtggagtccattgaggttgagaagtacgagggctacgtgtacgacctctctgtggaggataatgagaatttcctcgtgggcttcgggctgctctacgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3107 - DNA, 4346 bp, Artificial Sequence
  Synthetic Construct, AS-107 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgtccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3108 - DNA, 5060 bp, Artificial Sequence
  Synthetic Construct, AS-108 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttaccccagacacgctggtttcgctctcggacgggcggattattgagatcagggaggcggtggagaactcggaggagtcgctgctcgggatcaacggcctgaagccgaaggaggccaaggcgctcaagttctgggagatcgactgggatgggccgatcaaggtcatcaagctgaagaatggccacgagatcaaggctaccccagaccatgggctcctggttatgagggatgggaagatcggctgggtgtcggctaagaacattcgggagggcgactacgtcgccttcatctacaatctcgggcaccgcggcgggaagaagtacacgctcccccagctcctgaaggagctgggcatctccgagtacgagaactccagctcgcaggagctcaacaatcgcgagcaggagatggactccaagcagatcagcattgagctggatgagaggttctggtacatcttcggcgtgattctcggcaaggggaccctgaagggggacaaggtggtcatcttccagaaggatgtcaagccggttattgaggaggcgctgcccttcgtccggatcttcgagtcggctgaccacatcggcttctctcatctcattctggctgaggtcttccgcaggctcggcgttggggagggcaagctccactccctggtgttcggcctgagggaggagtacatcaacgctatgattgccgggtacttcgacgctagcggcaccttcctcaggagggctgtcctgacgagcaagcgcggcgatatcctcaggatgctgtcggtgtacctctaccagatcggcattgtcaacaatctgaggagggacgagcatgctggcgtgtgggagctcatcatttctgatctggagaagttccgcgagaagatctacccttacctcaggattaagaagtcacagttcgacaaggtctactctatttcaaagaacgagggcgatttcctcccggttgcgtctatcttccggaagctgaagttccgcgacggcttcaagaatcggatcctcgacgaggagattccacgcgatgaggtggcgaaggtcctggagtacgctgaggactcacctgagaaggagttcctcaactccctggttgaggccagggtgacatgggttcgggtggagaagatcgaggagaggcattacactggcaagctctacgacttcacaactactacagagaacttcatttccaatggcatcgtctcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3109 - DNA, 5000 bp, Artificial Sequence
  Synthetic Construct, AS-109 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgcgcctgggacaagggtcctgactgagcatggctactggctgaagattgaggagatgcctgagaagttcaagctgcagcggctccgcgtctacaacatcgaggagggccacaatgacttcagcaaggtggtcttcgtggctgagagggaggtcggctcggaggagaaggctatccgcattgtcacagagtccgggaaggttatcgagggcagcgaggaccatccagtgctcactcctgagggctacgtgtacctgaggaacgtgaaggagggcgattacatcctggtgtacccgttcgagggggtcccctacgaggagaagaagggcgtcattctcgacgagtccgctttcgagggcgaggatccgcaggttgtgaagttcctgcgcgagaggaacctcatcccactgcagtggaaggaccctaaagtgggcatcctcgctcggattctggggttcgctctcgcgaatggctacatcagcgagaacgataatctcaccttccacggcaaggaggaggtcctgagggaggttcggaaggacctggaggagctgggcatcgaggcgattgtcgctgaggaggataagctcaaggttacgtctagggagttcgctttcctcctggagaagctggggatggcccacgactcaatcccggagtggatcattgagggccccctctggattaagaggaacttcctcgctggcctgttcggggctaatggctcgatcgttgagttcaagggcgacgtgccgctgcccattaccctcacgcattcgcgggagctcctgaacgatgtctctcgcatcctggagggcttcaaggtgagggccaagattaagatggggaagaatggctcataccagctcgtcatcgaggacgaggattccattcgcaacttcctggggaggatcaattacgagtacgacccagagaagaaggccaggggcctcattgcttacgcctacctgaagttcaaggagctcatgaaggggaacctgatgaccttcgaggagttcgcccgggacaggggctacgagggcgggttcgtggcggagaaggtcatcgaggttaagagcgtgaagccggagtacgataagttctacgatattggggtctaccactcagctcataatttcattgctaatggcatcgtcgttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3110 - DNA, 4958 bp, Artificial Sequence
  Synthetic Construct, AS-110 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtggacggggacacactggtgctgacaaaggagttcgggctcatcaagatcaaggagctctacgagaagctggacggcaaggggcgcaagattgtggagggcaacgaggagtggaccgagctggagaagccaatcacggtctacggctacaaggacgggaagatcgttgagattaaggccacccacgtttacaagggcgtgtccagcgggatggtcgagatcaggacccggacgggccggaagatcaaggtgacgccgattcaccgcctgttcacaggcagggtcactaaggacgggctgatcctcaaggaggtcatggctatgcatgttaagcccggcgataggatcgccgtggtcaagaagattgacggcggggagtacatcaagctcgattcgtctaacgtgggcgagatcaaggtcccggagattctcaatgaggagctggcggagttcctcggctacctgatggctaacggcacactgaagtcggggatcattgagatctactgcgacgatgagtctctcctggagagggtgaactccctgtccctcaagctgttcggcgtcggcgggcggattgtccagaaggttgacgggaaggcgctcgtgatccagagcaagccactggtcgacgttctcaggaggctgggcgtccctgaggataagaaggttgagaactggaaggtgccgcgggagctcctgctcagcccatcgaacgttgtgcgcgccttcgttaatgcgtacattaagggcaaggaggaggtcgagatcaccctcgcttccgaggagggggcttacgagctcagctacctgttcgctaagctgggcatctacgtgacaatttctaagtcaggggagtactacaaggtgcgcgtctcgcggaggggcaacctcgacactatcccagttgaagtgaatgggatgccaaaggtgctgccttacgaggatttcaggaagttcgccaagtccatcggcctggaggaggtcgcggagaatcacctgcagcatatcattttcgacgaggtcatcgatgtcaggtacattccggagccccaggaggtgtacgatgttactacagagactcataatttcgtggggggcaacatgccaactctgctccacaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3111 - DNA, 4952 bp, Artificial Sequence
  Synthetic Construct, AS-111 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttaccgctgacacaaggctcgctacacagcatgggctggtccctatcgggtggctgcaggctaatgggggggctctggactgcacggtggacaggagggctctgggcgaggataggagggggacagttactcgcgccgctgtgccagcgttcctcagcgctggccaggctgaggtcttcaaggttaccacggccgagggctaccagatcaaggccacagcgtggcacgagttctacactgctaggggcaagctcaagctgtcggagctcaaggctggggacgagctgtgggtccagtccggcaaggggcagttcggcgctcagggcagcggggctctcggcctcctgatcgggctgattaccggcgacgggcatttcacgaaccgcggcaaggatgagcaggctgccgttatctccctgtggggcgaggagaggcagctcgctgacgatatcgccggctctgtcaatgccctcattgctgggacctcactggctccgcgcgactacctcgtgaagccagttgctgtggccgagcggaacatggtcttcattcgctcaaccatgctcgtcagggttctggatggctacgggttcaatggcgagacgaagctggaggtgccagaggtggtctggaggggctccgaggcttgcatgaggggctacctccaggggctgttccagacagacggcactgtgaacgtctccagcaattcccagagctgctcggtgcggctgtcgtcttcacaccgccctctcctgcaggatgttcaggtgctcctggcgaacttcggcgtcttctcgcgcatccatgagaggagggaggctggcccaaggtctctcccagacgggcagggcgggcagagggattacctgtgccagacacagcacgagctcatcgtggacggcgagtctcgcgaggcgttcatgagggagattgggttcctcctgcccgctaagcgggagaagtacgacgcttgggtcgccgataaggcgctcgttaagacccagaggttcgcggctaccatcacggcgattgagccagctggcgtggagcctgtctacgatactactcagccagacggcaacacagtcatcttcaatgggctcgttacggggcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3112 - DNA, 5198 bp, Artificial Sequence
  Synthetic Construct, AS-112 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctctctgcggatcatgaggttctcacatctacagggtggaaggctctccccgctattaaggatgcggatcaggttatgacgctggacctccagacgggcacacagcagtggaactcggtgcaggctaccacgaggttcgcgcgggagggctcactctacaggctgaagtccgacgatatggatgcggtctgcaacgagtctcaccgctggtacctcaatactaaggaccagccaacaacttacaccgctttcaccacgcagcagatgctggataaccagctcgtggctctgcgcaactcctccggcaaggctacggaccagtggaaccacgagtccgggacaactacccacacgaaccataatatccctacagtcggccataacgggaatgttatgttcagctggccagactgcccatggctcccacgcgagttcgtcgctgatgaggcgtgcaacctcgactggtgcaggttcatcggcctcgtgatgggcgacgggtcgattgatcatgtcacggacgctcagggccaggagcactacagcatccagattcatcagagggctgggaacccagcttcgaacgctaatacagaggatgtcctggagaggctggctgctaagctgccaaatttcgtggtccacccatcctgcgttagcggcgcggaggagaagcatacttggaccatcaaccaccgggacatgtaccatttcttcctccccatgatgcgcggcccacagtcctacgaccctctggataacgccatgtgcaggacctaccaggctccagattaccaggccctctcgcggtctgacaatgagcctatcattccagtgccagctgactggaagaccggcaactggtggcacctgcgcaggtggatcaattacccatggctcttctcgctggcccagtctcaggcgagggctatgattaagggcatggctgccgcgaacggggattggtcactctccctgaaggctaggctggacaccggcgattctggggttgtgagggttttcagcaattcgatccccctcatgcacgacatgtcagtgctgggcctcctggccgatactcgcgtgaacattggcgtcgaccataagaaggggcagatgcagctccaggtccctgttaccatgccggcgctcctggcttggtgcatctctttctcattcgcgaactccgacctggctgtggctgctccaaagcctgaggcgtacgataatccgaggcacgacggcttcgtttactgcctcacggtgcccaacgggaatttcctggcccggcgcacagtcgagtacagcgataatgataagattcaggaggtcattgatgctgctcagaagcctttcttcacaggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3113 - DNA, 4970 bp, Artificial Sequence
  Synthetic Construct, AS-113 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttactgcggatacatgggttatgactacggcggggccggctcaggtttcggagctgacggggcggtctttctcggctgtcgttgacggcaaggcctacgcggtgacatccgatgggttcttcaggactggccacaagccagtcctcgctctgaggaccagggagggccctgctctccgcctgacggctgaccatagggttcgcagggtggctaggaggaccaggtacacgctggaggctgagtggaccgaggctgggcagctgcagccaggcgacgagatcctcctgcacgatcatagggctctcggcgggtgggagggggctggcacacacgctgaggggtacctcctgggcctcctgatcggggacggcactctcaagtccgataaggctgtcattagcgtttgggctccagagctgaaggtggctggcgggggcgctgtcgcctacgcgcagaccggcgccgggggcatcgttcaggccgcggaggctgctgctgctacgctctcccacagggtcgacttccggggcttccagaggtcgatttctgggaggggcgaggctaggatggcttctggcgccgtgcggcacctggctcatgagatggggatgaggccaggccataagacaatcaccacggccatggagaaggcgtccagcgtcttcactgaggggctcctgaggggcctcttcgacgctgatgggagcgttcagggctcgcaggagaagggcgtgagcctcaggctgtcacagtccgatctctcgctcctgcagaccgctcagaggatgctcctgaggctgggcatcgcctccacgatctacccgaacaggcggctcgctcaggctaggccactgccagacggcagggggggcctgcgcgtctacgagacagcgtcacagcacgagctcgttatctccgctgataatctgaggatctacgccgagcggattgggttcgccgacacggataaggctgacaggctcgatcaggctctgggctcttacaaccggtcactcaatcgggagcgcttcacagtgactgtcgagtcgctgaccgaggagggctctgaggacgtgttcgatgttactgtggcggatattcatgctttcgatgctaacgggctctacgttcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3114 - DNA, 4928 bp, Artificial Sequence
  Synthetic Construct, AS-114 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctgcgggggttctctcgtcaaagattaagattcctgggggctggaagactatgggcaatattcgggtcggggatgaggtcgttacgccagacggcgggacagctaaggtcctcgctgttcacccacagggcgtgactaaggtggtcagggtccatttcaaggacggccggtacacagacgtctcgcccgatcacctctggaaggttcgcaggcaccattggtgcaacgataaggccatggcgaagctgactcgcgaggaggtggaggagagggtgtggagggtcatcaccacgaacgagctcaaggactacattggcctgagcacgaaggtttacgtgcagctcatcgagccggagaggaatgcggataagccattcaagattcacccttacgttctgggcgtgctcctgggcgacgggtgcatctcccagaaggctgtcgatattaccaagccataccagcagctcttcgacaaggtgcagagcctcctgcctgagcacctggagtgcgtctggaggccaaacaggaagggcgacggggagcccaagaccttcggcatccgcttcaaggatcggcgctccgagcagcacatcaattggcatattcgggacggcctgaaggagctcggcctgtacgggatgcgctcttggggcaaggtcatccccgaggagtacctccacgggtcagctaagcagaggctggagctcctgcagggcctcctggacaccgatgggacggttgataagcataagtcagtgtccttctccagctcgtctaagctcctgagcctcggcgtccagtacctcgttaggtcgctgggcgggatggctaggctgcaggagcgcacaccacactacactcataatggcgagaagagggaggggcggaccgactaccgggtctacatccgctacccgaggcccgaggagctcttcacgctggatcacaagagggagcgggcggtgtcccaccagcatacagagactctccgcctgcaggtcacccatatcgaggagaggcctgacgaggagacgcagtgcattactattgatcatccagatcatctctacattacggacgacttcatcgttactcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3115 - DNA, 5177 bp, Artificial Sequence
  Synthetic Construct, AS-115 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggggacaaaggttctcatggctaacggggatgacaagaatattgaggacatcgcggtcggggaggaggttctcgggaaggacggcctcccacgcgaggtggtcgctctgcctcgggggagggagacaatgtacgaggtcagcgagaagactcagcacagggcggagaccgttttcggcacggcctcgtacacatgcaacgcgactcacaagctcgtgctgcagaccaatcagagggttaacatcacgaatcatgtgctccggggcgagtctcagacctcagttacgtacttccagatgaagaccgctgtggctgacgggagggagattgagctcccaaagctgtgcacgaagtccttccagcactccagccatggccgggagaacgcttggaagaaggccgaggtcttcgcgtccacaatcagccgcgaccccattgattggactgcggaggctcgcgacatctctaggctcggctaccacgtgcgcagggctaccaggcagctctggagcccagttctggtggagaaggaggtcctggctcctatgatcgccaagcggggcttcgatgagtccattgcgccgtacatggcttacctcgtggggctgtgggtcggcgacgggtactccgatagggccacattcagcatcgacattcaggatgtggagatccacgagaggattaaggacttcgcctcacatgctggcctgactccaaggatcgcttgctacaagaagtccagggatgctaccatttcactccacaactccgagacgcggggcaagaatgtccgccagaacctgaatacggggaacctcctgtggtcgctcctggctgagatctgcggcaagaaggagaatgagatgctcttcaagctggtgccaagcttcctccgctcagagtccatcgcggtccgggagtacttcatttctggcctggtcgactcagatgggcacgttaagcgcgacgaggctgataagtgctacagcgccacagtgaagactatctaccctgccgtccgggacggcctcgtcagcgttgcgcgctcgctggggattcagacaagcgtgtcggtcgaggaggccaaggaggtcaactcggttaagcatcaggagtcttacgccatctacatggccaactcctccgctctcgactcggtgctgtctaagtgcgctgctccaaggaagcgggctgaggagcccgtttgcgtgaacagggagccgcacccctacacgttccacatggtcgagaaggaggaggacgatttctacggcatcactctctcagaggactcggatcatcagttcctgctctctaatctcgctctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3116 - DNA, 5114 bp, Artificial Sequence
  Synthetic Construct, AS-116 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgcgggggacactctcattacactggctgacgggcggcgggttcctattcgggagctggtctcgcagcagaatttctcggtctgggcgctgaacccgcagacgtacaggctggagagggctcgggtctcccgggccttctgcacaggcatcaagcccgtttacaggctgaccacgaggctcgggaggagcattagggctactgctaatcaccgcttcctgaccccacagggctggaagagggtggacgagctccagcctggggattacctggctctcccaaggaggatccccacggccagcacaccaactctgaccgaggctgagctcgctctcctgggccacctgatcggcgacgggtgcactctccctcaccatgtgattcagtacacctctagggacgctgatctggctacgctcgtcgctcatctggccacaaaggtcttcggctcaaaggttaccccgcagatccgcaaggagctcaggtggtaccaggtgtacctgagggctgctaggccactcgctcctggcaagcgcaacccgatcagcgactggctgagggatctcggcattttcgggctgcggtcgtacgagaagaaggtccccgcgctcctgttctgccagacgtccgaggccatcgcgacattcctgaggcacctctgggctactgacggctgcattcagatgaggagggggaagaagccatacccagctgtgtactacgcgacctccagctaccagctcgcgagggatgtccagtcgctcctgctccgcctgggcatcaacgccaggctcaagaccgttgctcagggcgagaaggggagggtgcagtaccatgtgaaggtctccggcagggaggacctgctcaggttcgtggagaagattggcgctgtcggggctaggcagagggctgctctggcctcggtttacgactacctctctgtgcggacgggcaacccaaatcgcgatatcattcctgtggctctgtggtacgagctcgtccgcgaggccatgtaccagaggggcatctcgcaccggcagctgcatgcgaacctcgggatggcttacggcgggatgacactgttccggcagaatctctctcgggctcgcgccctgaggctcgctgaggctgctgcctgcccagagctgaggcagctcgctcagtcagacgtctactgggatccgatcgtttccattgagcccgacggcgttgaggaggtgttcgatctcactgttccagggccacataacttcgttgctaatgacatcattgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3117 - DNA, 4946 bp, Artificial Sequence
  Synthetic Construct, AS-117 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacggcggagacatgggttatgacggatgagggggctaggcaggtctcggctctgctggatcggcctttcagggcggtcgtgaacggcatcgcctacgattcaggcgagcacgggttcttctgcaccggcctcaagccagtgaagaggctgtccaccgcttgcgggaggcacctcaggctgacggctgaccatctggtccggaaggtggtcggcaagacgaggtggaggcaggaggttgagtgggtgccagctggcgacctcaggcctggggatgaggtgaagctgcacgaccatcgcaccgcgatgattcagacgaggcctgaggatgagaggggctacctcctggggctcctgatcggcgacggggttattcgcgacgataagacactcatctccgtgtggccacaggaggagtgcattggcgctcagccactggggcaccccgtcatgcataaggttgaggctctcctgagggacctcccacacagggctgatttcgctggctggcagaaggtcgagggcaggggggagtacaggatcggcacagctgctctcactgctctggctgctgagtacggcctcacacgcgggaggaagaccatcacgccggagattgagggcgctgagactgctggcttcggggctgctgtcctcaggggcctgttcgacgctgatggcagcgttcagggggctcaggagaagggcgtgtccgtcaggctcgctcagagcgacctggctctcctgcaggctgctcagaggatgctcgctaggctgggcatgaacgctgtgatctacgagaatcgcagggaggcgggcagggctttcctgccagacgggaagggcgggcaggctcacttcgagaccaaggcgcagcatgagctcgtcatctcgggcgagaacctggcgacataccaggagcggattgggttcactgatgtggctaaggctaggaggctcgctgtcgctctgtcgggctacaagagggccctcaatcgggagcgcttctctgccgttgtggcggacgtcgttgacgatggcatggcggaggtgttcgatgttcaggttccaggggttaatgctttcgatgctaatggcttctacgttcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3118 - DNA, 4874 bp, Artificial Sequence
  Synthetic Construct, AS-118 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcaagcgggggacagaggtcattatgttcgatgggacaactaagaaggtggaggacgttatcgtgggggacgttctcatggggccagacagcacccctaggaacgtgctctcgctgggcagggggagggagatgatgtacgaggtgaagccacggaagggcgagtcctacacggtcaatgagtcacacatcctctccctgcgcaccacgacaggcattgcgaaggggtcctggcctgacaacacagtcttcgatatcagcgttcgggactggctcaagctgccaaagtatgtgactggccctaatgggtacctcaagggctggagggtgccagtcgatttcccaaggaaggagcaggacgaggctctcctgccaccatacctgatgggcctctggctgggcgacgggacttccagctcgggcgctatcacctcgggggagaatgagaaggagattagggcttacctggagtcttacgctgctaggaacggcatgcagatcaggaaggaggggctgacttggtctatttcacacggcaacaccgggcacaagaagcatggcttcacgcatgcgctcaagagcgctggggtgctgaacaataagcacatcccgcataactacaagtgcggcgataggaggcagaggctggagctcctggctggcctcctggactctgatgggtactgcgatctctcaaaggctggcttcgactggatttccgttagcgagaggctggccgacgatttctgctacctctgccggtcgctgggcttcgctgcctacaagaagaagacctgcaagcgctgcgcgaacacagacgtctggggcgattacttcagggtttcggtgtctggggacttctccgaggtgccattcgtcaggggcaggcatcagaatctccccaagcgcaacatcaataagaacgttctgaacgtgggcatcgagtccattacccccgtcggcgttgacgattacttcgggttcacaattgatggggattcaaggttcctcctcggggatttcacagttactcataatacctccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3119 - DNA, 4844 bp, Artificial Sequence
  Synthetic Construct, AS-119 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcctgctcagccgctggattcgctcgttctcgcgcctacggggttccgccgcatgggggatctcagggagggggatgaggtcgtggtccctaacggcgagatcgcgctgattgacggggtcttcccacagggcgtcagggacgtttggcggatcgtgctgagcgatggctccagcgtcgagtgcgacgatgagcacctctggattgtcggcacatcgtgcgggtggcataggggccagactccgaaggtcatgaccacgcgcgagatcaggctcgacacattcaaggccaacggctcctccaagtggtatgtgccagctgctaccccagtcgacctggggccagatgttggcctgccactcgacccttacctcttcggcctcctgctcggcgatgggtccttccgccacaatctgaggctcagcaccgtcgacgatgagatcagggacgctgctgctgatgctgtggctccggactgccggctggtgcccgtcaccggctcgcgctgcgattacacgatccagctcaagcagcggtctggcggggttcgcaacccagtgattcaggctctgaggaggctggacctctgggggaagacctcccacggcaagttcatccctgaggatttcaagaacacgtctattaagaataggctgtcactgctccaggggctgctcgacacagatggcactgttcatgccgacgggatgtcagtgtccctcaggagcgcttcgctgaggctcgctgaggacgtcgcttggctggttcgctctctcggcgggagggctcgggtcctcccagagaaggctgccttccatgtttcagtggctctgccagacgagtacgctcctttccggctctcccgcaaggctgatcgcgtgaggccaaggcccaagtacaatacgttccggaggggcatccgcgctgtggagtatgtgggcaggaagccggctcagtgcatttctgttgggcatccttcacatgcttacgttacggataatttcactgttactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3120 - DNA, 5327 bp, Artificial Sequence
  Synthetic Construct, AS-120 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggggacacaggttatgatggcggacgggtcggacaagtcgattgaggatattcagctcggggagaatgttatgggcaaggacggcacaccaaggactgtgatctccctcccccgcgggaaggagacaatgtacgaggtctgccactccagcaccaagggcaccacgaaggacacgctgatgaactacgtgtgcagcgggaatcataagatcgtcatgcagacaccacagcagatcggcattactgagcacggcattgacgggaagacctacacgagcgtctcgtacttcgctctcagggattcgcagcacggctaccctatcgttaagaagctgacgaagtctttcgagcatcagcagcacggcgggaaggagcagaccctcatcacggttaacaatttcgtgtcgtctctgaagtcggagccgattaactgggacgtggaggccaagcattacgagtccctcggccactacgtcaagaagtgcagctaccagctgatcaacccggttttccatcagagcggcaagctcgcccaggagattgcgtcgctgaattactctaaggacaaggctcccctcctggcctggctcatcggcttctgggtgggcaacggggctatgcgccactctcagttcgtggtcgagtcacaggacattgagctcgtcaacaggatccaggatattgcgggcctcctgaatctgtccgcgacaactgcttgctactactctggctcaaaggacgatgaggccaagctcgcgaagctgaactcatccagcgctgagggcttcgaggacgacctggaggggaatccaagcgtgaaggagctcgcggacatggataggctgtccgagagcaagacagcgactctgcctaccgctttcggcgtcgagaacatcgacgagctcatcatttcactgggcgaggggaggggcaacgggaatgtcttcgcccaggttatcggctctttcgggattgacctcgctgacaaggatacactggttactaagatcgcccatgagctcgctggcgacgccttcgaggtgagggagcagttcgtggctggcctggtcgatgctgctggctacgtgcgcaaggacgtgtacgatcacgcgtcagaggctaccatctccacggagtcgaagtctaccgtcctcggcctggttaagattgccaggtccctggggatcaagattaccgtgacgtcagacgattccgacgatagcgacgagcacgatcatgcgcactgcggccatgaccacgggtcgtcttcatcctacacagccgtcatgactggggatgcgctcacgaacagcatgcggttctgcgcgatcggccgcaatagggttgctgccaaggagttcatgcgccaggctgtgcccttctacttcagcctggagaagaagtcggaggacgattactacggcatcacagttccagataatacggataagcagtacctgctctcttctatggctctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3121 - DNA, 5270 bp, Artificial Sequence
  Synthetic Construct, AS-121 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcagtctcttacgatacgccagtcctcatcagggaccctattaacaagatccatctcgtgaagatcggggagttcattgataagttctacgaggagggcgaggagaggacggctaagcacgtgaatgggtactacgtcctctcccatgacggcttccaggtggtctggaagccgatcaagtatgtgctgcggcaccgcacaaacgagatctacgagatcatctacgagggcgggggcaagctggaggctaccggctcgcattctgttttcgtgctcgacccggatacgctggatatcgtcgagaagcccgttatgctcctgaataagggggagtacctggtttctttcaacggcgtgaaggagaataaggaccaccagacaatcgacctcattgatctggtttcggactacaacgatgtctacgttgataatatcccatctgagctcaagaagcatactgggggcaggaacccaatccctctcaagcagtacatgatcctgaggaagcgggtcattacaaagaagaacaatagcctcatcaagctgcgcaggtcgaagtacactctcccgattcggctcgtgctggacgagaagctcgccttcctgttcggggcctacatcgctaacggctgcgtcaaggagaggagggacaagctgatctgcttcaccttcggcaagtccgccaagaacatcgcggataaggtcatgaatattatgtacgagaagttcaacatcaagccattcattgacgatagggggacatacatcatctacgagtaccctcacactctcctggcgatcattttcgagaagctcctgggccgcaagctggaggagaagaagatgccagagatcctgtggtccagccctaagagcgtgattcgcgcgttcttcgagggcctcagggcttactcccagcgcaccctgaggaggaggtacacgagctacaccacggctaacaagaatctcgcctaccagctcctgtggctggctaggttcgctggcttctactcggtcctcaaggaggagaaggaggccgggaagaacaatggcaagacgtactaccatgtgatcgtctacctggaccagtcttacaggaagccgaacgcgtcagagcgggttccggtgaagcccatcctcaagctgattaagtacacaaagccaaggactatgccaccagagctcgcttacatcaagaggcgggagttcatttcaaggaagaccgcgctcaaggctctggagtggatccgcagggacggctcattcacggatttctcccgcgagtacctcaggaagatcgagtccctgattaacggggacatcattgtcctgaagatcaaggatgttcgcaagaagcagtacaagggctacgtgtacgacatttcagttccaattacggaggctttcttcgggggcaacattccaatcctgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3122 - DNA, 4880 bp, Artificial Sequence
  Synthetic Construct, AS-122 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcataccataaggatttcaagattatgctcgctgacgggcgcaaggttcgcatcggggatctcgtggatgagctgatcggcaagaatagggagaaggttatcaagggcaaggacacagagattctgttcgtggacgatctcttcctcctgtcgtacaatatgcggtctggggagcaggttctggtgaaggctgatcgggtgagccgccacaaggctccagaccagttcatcaagctgcgcttctcgaacggcgctgagatcattgtcaccccggagcatcccgttctcatcattaacaatggcaagatcaagaccgttagggcggatacggtgcggaaggggaccctgacgatcggcgtgctcgggcacaagatcattaaggaggtcaacgaggacgatatcattaacaatatccgcaggaagattgtgctggacaaggagctcccgtacatccacgctaagaatatttcagaggccgtcgagatgcgggaccagctgatgtccatcgatattcccaccttcatcgttaagcataagaacgagattcgcctgtacccatccggcccttgcagcctcaggaggctcctgctcatgcacggggtcgaggaggtggtcttctcggacgagctgctctacgagatcatgaattgccatctctacccggccacctggtacgagctgctctactccatgggcctgacgaagatcgccaaggagctcaacgtgtacgacttcgagattctggcgggcatcattaagaaggtggagaaggaggtcatcatgctctctcaggtcctggggctccgcaacgagacacagactgagctgctccatctgaagtcaaggcgggagctgctcatcaggctcaaggacaagctggatatgctccgcaagaggctgaaggacctggaggaggccctcggcaaggatgccgtgatcaggatgattacagacgtcgaggttatcaagaacactgactccgattgggtctacgacattactattgagccttaccacctcttcgtttcggatgggctcattctgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3123 - DNA, 4862 bp, Artificial Sequence
  Synthetic Construct, AS-123 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctcgggaaggggacaccggttatgatgtacgatgggcggacaaagccagtggagaaggtggaggtcggggacaggctcatgggggacgatggcagcccaaggacggtgcagtcgctggccagggggagggagcagatgtactgggtccgccagaagaggggcatggactacagggttaacgagagccacatcctctcgctgaagaagtctaggagggagggcgcccgcgacagggggtcaatcgcggatatttccgtccgcgactacctggatcagtctgacaagtggaaggacgataacaagggcttcaaggtggctgctgagttcccagaccagccagtccccctcgatccttacttcctcggcctgtggctcggcgatgggaagtccgacaatgctaggatctacaccacggacgaggaggtcatcacgggcctgcaggagattgccgagaagcggggggacacaatttcagtgtccgatgagcatcggcgctgcccagcctacctcgtcaagtctggcgacaggggcggggctatggctaccagggagtcagttcagggcgctctgagggctctcggcgtgctgggggacaagcacatccctcatctgtacctcggcaactccagggggaagcggctcaggctcctggctggcctgattgacagcgatggccacctcaatgacgggcatggcgggacgtacgagatcacacagtccagcgagcagctggcgagggacattaagttcctctgcgatactctgggctaccggacatcgctcactcagaagaccgctcgcatctcgtctaccggctacgagtccgaggttcacagggtgcggttcaacgggaatgttgacgagattccggtgcgggtcgagcgcaagaaggcttccccatggactgatgtcagggactggcggatgaccggcatcgatgtcgagcccgacggcgttggggattacttcggcttcactctggatggcaatgggcgcttcctcctcggggatggcactgttactcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3124 - DNA, 4904 bp, Artificial Sequence
  Synthetic Construct, AS-124 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgatcctgagacagaggtcgtgacagtggacggcattaggcatgtggaggagattgaggtcggggatagggtttactcgctgaacccagacacgggcgctgtcgagatcaagcccgttaccgcgacgcagagccagcattacgctggcccgatggtggagattaagaaccagcataccgacttcctggtcacgcccaatcaccgcttcctcacacagaggttcacttcgggcgagtacacagatctggagtgggagactgctggcgacatgctcggggatcgcatccgcaggaggctcccatcactgaggtccctccctgctacacaggagaggccaggccctatctcactgtccgctgtgtgcgacaggctcgctatcgagcacaagactggcccacgcgggattaaggagctgaggaggcaggctaggtggcagcctgaggagtacgagctcacagattggctgaggatcctcggctggttcgccacagaggggactctgtacaagtctaaggcgaggcagtacgagaacggcaatgtgcggggggtctcataccagaccacgctctgccagaagaacgacatcggccgctccgagattgcgacgctcctgaacaggaccgggatcacgtactccagcgaccagaatgatcatagcttctgctcgaaggttctgtacgagattctggaggctgagtgcggcagcgactcgttctctaagcacctgccaccatggatcttccagctggggccaaaggacctcaagattgtcttcgataccctcatgcagggcgactccgctgctaacggggatcggttcacaacttcgtctaatcagctggccgaggacttcatcaggctcgctatgcacattggcaggagggctttccacatgccgaacgatgggtctcacaggatccaggttaataccgtgaggggccagcggccgacgattaagcccaagcatcggcagcaggtcgactacgatggcatgatccactgcctgaccgtggcggataatcatactgtgctcgctggcaggaataggaagttcaattggactgggcagtccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3125 - DNA, 5117 bp, Artificial Sequence
  Synthetic Construct, AS-125 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcatttcgggggatagcctcattagcctcgcctcaacgggcaagcgggtttcaatcaaggatctgctggatgagaaggatttcgagatctgggcgattaacgagcagaccatgaagctggagtctgctaaggtttcacgcgtgttctgcaccggcaagaagctggtgtacatcctcaagacgcggctggggcgcaccattaaggctacggccaaccacaggttcctcacgatcgacggctggaagcggctggatgagctgtcactcaaggagcatatcgccctcccaaggaagctggagtccagctcgctgcagctcatgtccgacgaggagctcggcctcctggggcacctgatcggcgatgggtgcaccctgcctaggcatgccatccagtacacgagcaacaagattgagctcgcggagaaggtggtcgagctggcgaaggctgtcttcggcgaccagatcaatccgaggatttcccaggagcggcagtggtaccaggtttacatcccggcgagctaccggctcacacacaacaagaagaatcccatcactaagtggctggagaacctcgacgtcttcggcctgcgcagctacgagaagttcgtgccgaatcaggtcttcgagcagccacagagggctatcgcgattttcctgcgccatctctggtcgacagacgggtgcgttaagctcatcgtggagaagtcttcacgccccgttgcttactacgccacttccagcgagaagctggctaaggacgtgcagtccctcctgctcaagctcggcatcaacgcgcgcctgtcaaagatttcccagaacggcaaggggagggataattaccacgtgacaatcactggccaggccgacctccagatcttcgtcgatcagattggggctgttgacaaggataagcaggcctccgtcgaggagatcaagacacacattgcgcagcatcaggctaacactaatagggacgtgatcccaaagcagatttggaagacatacgtcctgcctcagatccagattaagggcatcaccacgcgcgatctccagatgaggctgggcaacgcttactgcgggacggctctctacaagcacaatctgtcgcgcgagagggctgctaagatcgctaccattacgcagtctccggagatcgagaagctctcgcagtctgacatctactgggatagcatcgtgtcgattacagagactggcgtcgaggaggttttcgatctcactgttccagggccacataacttcgttgctaatgacatcatcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3126 - DNA, 5135 bp, Artificial Sequence
  Synthetic Construct, AS-126 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttctcgggggatactctcgtcgcgctgacagacgggcggtcggtttctttcgagcagctcgtggaggaggagaagcagggcaagcagaatttctgctacacaatccggcacgacggctcgattggggtggagaagatcattaatgctcgcaagacaaagactaacgccaaggttatcaaggtgacactcgacaacggcgagtctatcatttgcactcccgaccacaagttcatgctgagggatgggagctacaagtgcgccatggatctcacgctggacgattcgctcatgcctctgcatcgcaagatctcgaccacggaggactctggcatcaccattgatgggtacgagatggtgtggtccccgaggtccgacagctggctcttcacgcacctggtcgccgattggtacaaccggtggcagggcatctacattgcggaggagaagcagcattgccaccataaggacttcaataagcgcaacaataacccggataacctcatcaggctgtctcccgagaagcacctcgccctgcaccggaagcatatttcaaagacactccaccgcccagacgtggtcgagaagtgccgcaggatccatcagtcccctgagttccggcgcaagatgtcagcgaggatgcagtccccggagactcgggctatcctcagcaagcaggctcaggcccagtggcagaatgagacctacaagctgacgatgatggagtcgtggaggtctttctacgacagcaacgaggattacaggcagcagaatgctgagcagctcaacagggctcagcaggagtactgggctcaggctgagaacaggaccgctcaggctgagcgcgttaggcagcatttcgctcagaatccgggcctgcgccagcagtactcggagaacgcggtgaagcagtggaataaccccgagctcctgaagtggcggcagaagaagacaaaggagcagtggactccagagttccgcgagaagaggagggaggctctcgctcagacctactacaggaagacgctcgccgcgctgaagcaggtcgagatcgagaacgggtacctggacatttcagcctacgattcctaccgcatcagcaccaaggacaagtccctcctgcggttcgatcgcttctgcgagaggtacttcgagaatgacgagaacctcgcgcgcgaggctgtcctgaattacaaccacaggatcgtcaacattgaggcggtttccgagacgatcgacgtttacgacattgaggttccacatacgcataacttcgctctcgcttcaggggttttcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3127 - DNA, 5090 bp, Artificial Sequence
  Synthetic Construct, AS-127 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcatttctatggactctatgattctgacaactgagggctacaagtcgctgcaggagattttcgagacacagggggttaaggtggacaacaaggagaaggttatcgagctgaagtacccgctcattaatcggtacggcgacgtggagtacacctcccacttcacgaagaacggggagaagccaacaaagcgcatcaagactaataagggcattgagctggttaacacatacaatcatcctctcctggtgagggaggggttcaacctgatctggaagaagagcgaggacatcgaagtgggcgatattctcgtgtcccgcgtgggcgaccaccagttcgggaacaataacactgtggagaacgaggaggaggcttacgctctgggctgcatggtcgcggattcttacctggggtcatactcccggctcagcttctcgaacgacaagaaggagatcctcgataaggtctcaaagttctggaacaccttctccaataaggaggtttactacgacacctacaaggagtccaaggggatcacgattcacctgcatgacacaaacaagactaaggagttccatgataagtacaagatcgagtacggcgtcgctaaggacaagaagatcccgaagtgcattatggagagccccgagaacatccagctggccttcgtctcgggctacctggagtgcgagtccagcatctctgagaagaacctggaggttacctctgcttcaaaggacctcctgaaggatctccagctgatcctctcgaacatcggcattgtgtctacgaataaggagaaggtggtcaagaagtacaagcacaacaagtactaccggctgatcgtcaatcgcaaggagctcattaagctcctgccgctcctgaggttcgagacgcagcagcggaagaaccagaaggagaatttcctcagcaataacacaaagatcaagtcgtcttacggcaacactattgaggggtcacgctacctcctgaagaagtacagggactccctgaatatcgataagaaggagttctccaagtacctcagccgggacaccatcacgattgatcgcctgagggaggtcatctcgctctacccggacggcgataaggagattcgcgagctgttcgagaacgttgtgaataacaatatctactaccagaaggtggagcaggtcctggagggcgagatcattcccaccttcgacgtttgcatgcctaagactcattccttcatcgccaacacaatcgtcaaccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3128 - DNA, 4910 bp, Artificial Sequence
  Synthetic Construct, AS-128 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgccatcctgcggacactaaggtcatcgtgaagggcaagggcatcgttaatatctcggacgtgaaggagggggactacattctcggcatcgacggctggcagcgggtcaagaaggtttggaagtaccactacgagggcaagctcatcaacattaatgggctgaagtgcacgccgaaccataaggttcccgtggtcacagagaatgacaggcagactcgcatcagggattccctcgccaagagcttcctgtcgggcaaggtcaaggggaagatcattaccacgaagctcttcgagaagatcgcggagttcgagaagaacaagccgtcggaggaggagatcctcaagggcgagctgtctgggatcattctggccgagggcaccctcctgaggaaggacatcgagtacttcgattccagccgggggaagaagcgcattagccaccagtaccgggtggagatcacgattggcgagaacgagaaggagctcctggagcggatcctctacattttcgacaagctgttcggcatccgcccatcggtgaagaagaagggggataccaacgcgctcaagatcacaactgctaagaaggccgtctacctgcagatcgaggagctcctgaagaatattgagtcactctacgcccctgcggttctgcgcggcttcttcgagagggacgctaccgtgaacaagatccgctctacgattgttgtgacccagggcacgaacaataagtggaagatcgacattgtcgcgaagctcctggattccctcggcatcccatacagccgctacgagtacaagtacattgagaatgggaaggagctcacaaagcatatcctggagattactggcagggatgggctcatcctgttccagacactcgtcggcttcatttcgtctgagaagaacgaggcgctggagaaggctatcgaggttagggagatgaaccggctcaagaacaattctttctacaatctgtcaaccttcgaggtgtcatccgagtactacaagggcgaggtctacgatctcactctggagggcaatccttactacttcgccaatggcatcctcacacataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3129 - DNA, 5444 bp, Artificial Sequence
  Synthetic Construct, AS-129 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttctatcctgcctaacgagtggctgcccatcatcgagaacggggaggtgaagttcgtgaagatcggggagttcattgatcgctacatggaggagcagaaggacaaggtgcgcacagtcgataacactgaggttctggaggtggacaatatcttcgccttctccctgaacaaggagtctaagaagtcagagatcaagaaggtgaaggccctcattcgccacaagtacaagggcgaggcgtacgaggtcgagctcaactccggccgcaagatccacattacaagggggcattctctcttcactatcaggaacggcaagatcaaggagatttggggcgaggaggttaaggtcggggacctcatcattgttccgaagaaggtgaagctgaatgagaaggaggctgtgatcaacattccagagctgatctctaagctccctgacgaggatacagccgacgtggtcatgaccacgcccgtcaagggcaggaagaatttcttcaaggggatgctccggaccctgaagtggatcttcggcgaggagtcaaagcggattcgcacgttcaacaggtacctcttccatctggaggagctcggcttcgtgaagctcctgccgaggggctacgaggtcaccgactgggagggcctgaagaggtaccggcagctgtacgagaagctcgtgaagaatctgcgctacaacggcaataagcgggagtacctggttcgcttcaacgacatcaaggattcagtgtcctgcttcccccgcaaggagctggaggagtggaagatcggcacaaggaaggggttccgcaggaagtgcattctcaaggttgacgaggatttcggcaagttcctggggtactacgtctcggagggctacgctggggctcagaagaacaagactggcgggatgagctactcggtcaagctctacaacgagaatccaaacgttctgaaggacatgaagaatatcgcggagaagttcttcggcaaggtccgggttgggaagaactgcgtggatattcctaagaagatggcttacctcctggctaagagcctgtgcggcgtcaccgctgagaacaagaggatcccgtcgatcattttcgactccagcgagcccgtgaggtgggcgttcctcagggcttacttcgtcggcgacggggatattcacccatccaagcgcctcaggctgtccacgaagagcgagctcctggccaatcagctcgtcttcctcctgaactcactgggcgtttcgtctatcaagattggcttcgactccggggtctaccgggtttacatcaacgaggatctgcctttcctccagacctcccgccagaagaatacgtactacccgaacctcatccccaaggaggtgctggaggagattttcggccgcaagttccagaagaacatcacgttcgagaagttcaaggagctcgcggacagcgggaagctggataagaggaaggtgaagctcctggacttcctcctgaatggcgacatcgtcctcgatcgggtgaagaacgtcgagaagcgcgagtacgagggctacgtgtacgatctctcagtggaggataatgagaatttcctcgtgggcttcggcctgctctacgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3130 - DNA, 9788 bp, Artificial Sequence
  Synthetic Construct, AS-130 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgcggcctacgatactctcgtgctgcagaaggacgggtcgctggttacgctggcggaggtttacaagcggcaggagattgagctgctcacactgggcaagaacagcaagttctacctcactaagccatcggccttcattgacgatggcatcaagcctattttccgcgtcaccacgaagctcgggaggttcgtggagacaactatcacccacccgttcctgaccgtgaacggctggaagcccctcagcaagctgcaggtcggggagaagattgccgtgccccgcaggctcaacattttcgggaatgagaccatctcggagtctaagttctccagcctgatcaacttcgacaatctctacctgttcccgctcgtgttccagctggagcggtcgcagctcgcgctgttcattcgctacctcttcagcctggatggctgggtgaagatctaccagaacaagatcgtctgcttcgggtactcaaccgtgtccgagaagctgatcaggcagattcagcacatcctcctgcggttcggcattgtctccgggatcgagaagttcgaggagaagcggacggagaagatcaaggtggtcaaggaggtgaagagccagcggtcgcaccgcgaggagttcacattcgctacttaccgcaactgctactgcgacggcaagtggcacctcaccattacggatgccctctcccagaagaacctgatggaggacatcggcgggttcgatagcaagaacttctacctgttcgacctcctgcagccgcacaacagcggcaatcaggagctggagaaccatctgatcttctgggatgagctcgttaatgtgctggcgaagttcgccgcgtctaagaaccagtcactcaagaatcgcaccgctaaggggaagtcccccaagaacagcgagaatctgaccacgacagagacgatttgcaggaagaacatcctcgccaacatggagaatctgccgagcgacaaccagaatttcgattcggagaagctcgacctgtctcagccccacaactcagggaaccaggagctggagaatcatctgatcttctgggacgagctcgtcaatgttctggccaagttcgcgacctcgaagaaccagtctctcaagaataggactaccaagcggaactcaccgaagaactccgagaatctgacgacaactgagaccatctgcaggaagaacattctggcgaacatggagaatctgccctctgataaccagaatttcgactcagagaagctcgatctgccgcagccccacaactccgggaatcaagaactggagaatcatctgatcttctgggacgaactcgtgaatgtcctggctaagttcgctgccagcaagaaccagtcgctcaagaatcgcaccacgaagaggaactctccaaagaactcagagaatctgacaactaccgagaccatttgccggaagaacattctggctaatatggagaatctgccttctgacaatcagaatttcgatagcgagaagctcgacctgccacagcctcataattccgggaatcaagagctggagaatcatctgatcttctgggacgaattagttaacgtgctggctaagttcgccacatccaagaaccagagcctcaagaaccggacgacaaagcgcaactcgccgaagaactctgagaatctgactaccacggagactatttgccgcaagaacattctggctaacatggagaatctgccatcggacaatcagaatttcgactctgagaagctcgatctgtcccagcctcacaacagcggcactcaggaactggagaaccatctgatcttctgggacgaactagtcaacgtcctcgccaagttcgcggcttcaaagaaccagtccctcaagaatcggacagcgaaggggaagagcccgaagaactcggagaatctgaccaccaccgagaccatctgccgcaagaacatcctcgcgaacatggaaaatctgccgtcagataatcagaatttcgattccgagaagctcgacctgtcgcagccccacaactctgggaatcaggaactggagaatcatctgatcttctgggacgaactggtgaacgtcctggcgaagttcgctacctctaagaaccagtccctgaagaataggacgacaaagcggaactccccgaagaacagcgaaaatctgaccactacggagaccatttgcaggaagaacattctcgcgaatatggagaatctgcccagcgataatcagaacttcgactcggagaagctggatctgcctcagccccacaactctggcaaccaagaactggagaaccatctgatcttctgggacgaacttgttaacgtgctggccaagttcgcgacatcgaagaaccaatccctgaaaaatcgcacaactaagaggaactcaccaaagaactccgaaaatctgactaccacagagactatttgccggaagaacatcctggccaatatggagaatctgccgtctgacaaccagaacttcgactccgagaagctggacctgccacagcctcacaacagcgggaatcaggagctggagaatcatctgatcttctgggacgaactagtaaacgttctggctaagttcgccactagcaagaaccaatccctcaagaatcggactaccaagcgcaactctccgaagaactcagaaaatctgaccaccactgagactatctgcaggaagaacatcctggcgaatatggaaaatctgccctccgataatcagaatttcgactccgagaagctcgatctgcctcagccgcataactctgggaatcaggagctggagaaccatctgatcttctgggacgaactagtgaatgtgctcgccaagttcgctacctccaagaaccaatccttaaagaataggaccacgaagcggaactcgccaaagaactctgaaaatctgaccacaaccgagaccatttgccgcaagaacatcctggccaacatggaaaatctgccttcggataatcagaacttcgattccgaaaaactggacctgccgcagccgcataattccgggaatcaggagctggagaaccatctgatcttctgggacgaactagttaatgtcctggccaagttcgcgacgtcaaagaaccagagcctgaagaatcgcacgacaaagaggaacagccctaagaactcggaaaatctgaccacaacggagacaatctgtaggaagaacattctggcaaatatggagaatctgccatcagacaatcagaacttcgacagcgagaagctcgatctgtcacagcctcacaactccggcacacaagaactggagaaccatctgatcttctgggacgaactagtaaatgttctcgccaagttcgcggcctctaagaaccaaagcctgaaaaatcggacaactaagcgcaactcccctaagaacagcgaaaatctgacaacgacagagacaatctgccgcaagaacattctcgcaaacatggaaaatctgccatctgataatcagaacttcgatagcgaaaaactggacctgccacagccacacaactccggcacgcaagaactggagaatcatctgatcttctgggacgaactagtaaacgtactggccaagttcgctgcgtcgaagaaccagtccttaaaaaaccgcaccactaagcggaactcacctaagaactccgaaaatctgaccacgactgagactatatgtaggaagaacatcttagccaacatggaaaatctgcccagcgacaatcaaaactttgactccgagaagctggatctgccgcagccgcataactccgggaatcaggagctggagaaccatctgatcttctgggacgaactagtaaacgtcctggctaagttcgccgctagcaagaaccagtccctgaaaaacaggactaccaagaggaactctcctaagaactcagaaaatctgactaccactgaaactatctgtcgcaagaacatcctggctaatatggaaaatctgccgtcggataaccagaacttcgattccgagaaactggacctgcctcagccgcacaattctggcaaccaagagctggagaaccatctgatcttctgggacgaactagtaaacgtgctcgccaagttcgccacctccaagaaccagtccctgaaaaataggaccacaaagcgcaactcgcctaagaactctgaaaatctgacaaccacggagacaatctgcaggaagaacatactcgcgaacatggagaatctgccttcggacaaccagaacttcgattcagagaagctggatctgccccagccgcataattccggcaaccaggaactggagaatcatctgatcttctgggacgaactagtaaacgtattagcgaagttcgctacctcaaagaaccaaagcctcaaaaataggacggccaaggggaagagccctaagaactcggagaatctgactaccactgagactatatgtcggaagaacatcctcgcaaacatggagaatctgcccagcgataaccagaatttcgattctgagaagctggacctgccgcagcctcataattctggtaaccaagagctggagaatcatctgatcttctgggacgaactagtaaacgtactagccaagttcgcgacctctaagaaccagagcctgaaaaaccgcaccaccaagcggaactccccaaagaacagcgaaaatctgactactaccgagacgatatgtcgcaagaacattctcgctaatatggaaaatctgccatcggacaaccaaaacttcgactccgaaaaactcgatctgccgcagccgcacaattccggtaaccaggagctggagaaccatctgatcttctgggacgaactagtaaacgtactcgctaagttcgccacttcgaagaaccagtcccttaaaaacaggaccaccaagaggaactcacccaagaactccgaaaatctgacgaccaccgaaaccatctgtaggaagaacatactggctaatatggaaaatctgccttctgacaaccagaatttcgacagtgaaaaactggacctgccccagccgcataactctggtaaccaagagctggagaatcatctgatcttctgggacgaactagtaaacgtacttgcgaagttcgctacaagcaagaaccagtccctcaaaaatcgcactgccaaggggaagtctccgaagaactcagagaatctgaccacgaccgagactatttgtaggaagaacatcctggccaacatggagaatctgcccagtgacaatcaaaactttgatagcgaaaaactggatctgccgcagccacacaactccgggaatcaggagctggagaaccacctgatcttctgggatgaactggttaacgttctcgcgaagttcgccacttccaagaaccagtccctcaaaaacaggaccactaagcgcaactcgccaaagaactctgagaatctgacgaccacagagacgatatgccgcaagaacattttagcgaatatggaaaatctgcccagcgacaatcagaactttgactccgaaaagctggacctgcctcagcctcataattctggaaaccaagaactggagaaccacctgatcttctgggacgaactagtaaacgtactagcaaagttcgccacctcaaagaaccagagcctgaaaaatcgcaccacaaagcggaacagcccaaagaactcggaaaatctgactactactgagacgatttgtcgcaagaacattttggcgaatatggagaatctgccaagcgataatcaaaacttcgattctgaaaaactcgatctgcctcagccacataattccggcacccaggagctggagaactccgacatcttctgggataagattgtgtccatcgagccggtcggggagaagcaggtgtacgatctcactgttccagagactcataacttcgttgctaatgatatttgcctccataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3131 - DNA, 5114 bp, Artificial Sequence
  Synthetic Construct, AS-131 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctctcggggtctacaaaggtcattgacgctgctacggggaatctcttctcgctcaaggagatcgccgctcagcctgagtactggctctcgcgcaaggtcttctctctcgacctgaagtcacagcaggtggtccagcagccaatcaccgagattcaccctaatggcgtgagggatgtctggcagatcaccacgaggaccaacaggaaggtgtgcgctacggacgatcatctcttctacacagtcctgggctggaagccgctcaaggacttcagcgttggcgatcgcctcgggctgccgaataagatccccattaactacaggtcccagatctccgacagcaaggtgaagttcacggcgtacctcattggcgaggggtacctgtacacaaattcgttctcttgctcatacttctgcaactccgacggggagctcatcgcggatttctacggctgcgctgaggagctgttcgggtccagcgctccaatcgagaagcagctccacctgggcaataagtccgtgatctacgtgcggatcggcctcatttccgggctgaagaactgggtcgactcctacctccagtgcgcgaatagccgcgtgcaggagatccccaactggattttctccctcagccagtcgcagctccagctgttcctcggcatcctgtggtctacgtcagggatcttcgacgagacaattggctacacttactactcgtctaacagcgaggtcctggttaggcaggtccagcatctgttcctccggctgggcatcgtttccctcttcaacgtcaataaggttaagggccagggggagctggacgtgtcctacgttgtggaggtccgcgggagggaggatatgctgaagttctacaagctcatcaagccgtacctgtcatcctacaagcagggcctctgcgagagctgctacctggtcattaagtaccagcagtcgtaccagttcaagtacttcctcactcccgacttcttcgatctgatcgtgaaggctaagaaggccagctcgatgaccagggctctcggcgtttgcggcggggagatctcttcagtgtggaacttccagaatacatctaaccggtccctgagcttcgacaagttcaacaatttctcgactgtcctcgcggatgaggagctgaccgccatcgcgaactcggacgtgttctgggatgagatcatttctatcgagtacattggcaaggaggaggtgttcgatctcactattccagagactcataacttcattgctaatgacttcatcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3132 - DNA, 4241 bp, Artificial Sequence
  Synthetic Construct, AS-132 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgacttacgagacagagattatgacagtggagtacgggccgctgcctatcgggaagatcgtggagtaccgcattgagtgcacggtgtacacagtcgacaagaacggctacatctacactcagccgattgcccagtggcacaatcgcggcatgcaggaggtctacgagtactccctggaggatgggaccgttatcagggcgacgccggagcataagttcatgaccgaggacggccagatgctgcccatcgatgagattttcgagcggaacctcgacctgaagtgcctcgggaccctggagatggttaagattgtgagccgcaagctcgctaagacggagaatgtgtacgatattggggttacaaaggatcacaacttcgtgctcgctaatgggctcattgcttccaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3133 - DNA, 5120 bp, Artificial Sequence
  Synthetic Construct, AS-133 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctgacgggggatcagaaggtcctctactacatcgctaagaagctctactacgagacattcgctgagtgctacgaccgcattaacggcgacatctccagcgttagcgtgccatgcttcgatgagaactaccagacagtgattaagcctatctcggccatttggaagcaccatgtgaagaagaagggcttcaagattaagatcacttgggggaagcagattaagatcacagaggaccacagcctgttcactaggaacgagaacaataagccgcaggcggttttcggcaatgagatcaaggtcggcgatgagattgggatcccctcctacatctccttcctggagcagccgctggagcccttccatattaccgacaagattctcatccaggaggagatctacgtggagtcagaggacacgatctcctacattgagaagtacggcgataagatgcgggagtacctcctggcgaagtcgctgtctccgtcacagttctactccattctcaagacatacgaggctaagaaccagatcccgtggcacctgtggaagtacctggagctgcccctctccgagaaggacaaggtctgctacctcagcaagaaggccattaagaactggatcgataatgtcgaggagctcctgtggttcctgggcttctacgttgccaggggctcactgatcaagaacgaggtggtcctcaagggcgagccatcccagctggagaaggtcatcgagctcattgagaggatcttcgagtacaagagcgagatcaatgactcgggctacatttcgatcaagtctaagattctcgttgatctgatcggctacgggctcaacttcgggaatcaggagaaggacattccaaactggatcctgcagctccctgagcagcagctcatccggttcctgaagggcttcgtggctgggaacaacctggagaaccagctgaatttctacctggagttcaagacggactctcagctggtggcggagaagctggtcctcatcctgtcgaagttcggcctcgtcgctgacgtttctgagatcgaggttaacgaggaggatattgccaagatctaccgcatcattatcgagggcctggaggacaagaacatccataatctctctaaggtggagcagaagatttcagctctgaccacgggcgatatcgcttgggggaagattgagtccatcgaggagttcgagatcgacgattacgtctacgacttctctgttccaaactacgagaacttcatcgggggctcttacaatgttttcgctcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3134 - DNA, 4799 bp, Artificial Sequence
  Synthetic Construct, AS-134 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtttcgggggatacgctgctgattacaagggactctattcataagattaaggatgtcgtggggcagaagattgagatttggaatggcaagaactggtctcaggtcatcccgctgaagacagggaaggacaggaagctctaccgggttcgcttcggcgacgggtcgtacctggatgttaccgagtaccaccgcttcttcgtgaaggacaggttcggcaagaagtacgaggaggtgcagaccaaggatctcctgacgcactccaagtacgccctggacgtcgagccattcatcattgattaccatgacggcgattcgatcaacctctcttacgcttacacactgggggctgctctcggcaatgggactatcgaccagaactctaatggcaagattagggtgtactcacataaggccgagctgatcttcgcgggcaacaagtccctggagcggcagtacaattacctcccgagcttcgtggacgtcattgatctcggcttctcgggggagctcctgaggaggctgcagaccgagcccgacgctctcaacacgatcgcctcatggaataagtccgctatcctggccttcattgcgggcctcgctgacacagatgggagcgagactaagggcaacgggatcaagatttccgtgagcgactacgagagggccaagcggctgcagctcctgctcacgaagtgcggcattagggcgagcgtcaatctgatggcttcgcggggctgcaccacgaacctcggggagcgcaatcaggacctgtactacctccagatcaccgattgccgggagattccatgccagcgcctcgacacaactaaggtttgcgaggcgaagttccagggcaagtaccagaccatccagaacgtcgaggagctgcctggcctccacgatacgtactgcttcgaggagccagagttccacaagggggttttcggcaatgctctcacaggcaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3135 - DNA, 4973 bp, Artificial Sequence
  Synthetic Construct, AS-135 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggacaagacggctctgcggattttcaatcaggggctgctctacgcggatgaggtcgtgacaccgggctcgggggagacagtcggcctcgggctgacggtcaggaacggcatcggggcgtccacagccattgcgaatcagccgatggagctggttgagatcaagctcgctaacggccggaagctgcgcatgacccctaatcaccggatgtccgtgaagggcaagtggattcatgcctgcaacctcaagccggggatgctcctggactacagcatcggcgagtaccagaagcgcgaggacaccctcctgattcctctccagctggaggattacactgaggtgaacaattcgcagaccctgggccacaacggcggggtcctcaccaagaagatcatgacgccggcgtcaatgacatccgacctggcttacttcctcggctgcctgttcggcaacgggtgcatcgtccagaataagtaccaggtttgcttctaccattctcggctcgacgtgctgtacggcctccaggagaaggggaagaagctgttcggcatcaaggggtctctcaacgatttcgccaatggcaggttcgagctgtgcttcgcgtcacggcagctcttctactggctccacctgaaccagctggtcaagacgcagaagtcagaggacctggagcgcatccccctctccctgaggaggtccagcagggttactctcctgtccttcttctgcggcctgattgacaccaacggctacgtgccacaggatggcaagctcagcatcgcttcggcctcgtctgatttcattcataacctgcagcagatcggcgagtccattgggctctgcttcagcatctaccagaatacgaagggggagaacctgcagaatcagcacaacaatacatggggcctctgcctgtctcccatgctctcaaacgtggacgcgctggattacctcaaccataatagcatcaagtgccaggagggcccggtggtcatttcgaagtgcgtcctcaactactcgccctacaagatcgagtctgttaatattggcgctgtgtgcgactacagctacgatttcgccatcgagggcatcaatgataatgactcttggtactggcagggggctctcaagtctcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3136 - DNA, 5237 bp, Artificial Sequence
  Synthetic Construct, AS-136 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtgctgcatgacactgagatctacgtgaatggcatggttatggaggcggagcagatttggcaggcttacgcgggggaggcggagttcgacggcgaggggttctggacagagccgaacaaggagctcctggttaatagcctcgatgagaccacgggcaagatcgtgttcgcccggattcgcaggctgtaccgccagtgggttagggagaagctcaggaaggtgcggctgaaggacggctccagcatcacaattacttgcaggcacaagctcttcatccgggactcctggaagaacgatttccaagtgggcgacgatgtctgcgttcccgcgaagctgatgtgggacgggaagccagaggacccagatgtggtcaagttcgtcgcttggcaggttgctgagggctgggagagggtcaattccggcatgttcggggttagccagaagggcaaggacgtgctggaggggctcctggaggtcttctcgcggctgggcaagcgctacgatatcaagattaactgcccaaaggttgtggcgcacgggtctaagaagaattgctacgagttcagcgctcattcgctggagtacaggaagttcctggaggagaagcgctacggctgggggaagaggtcccatgagaagaccatccctctgttcattatgcaggccgacctcgattcggtgcgggtcttcctgtctaactacttcgacgcggagggctgggtgaataagaccgttcgctgcgtggagatctccacggcctcgtctcagctcatccaggagctgagcattctcctgcggcgcttcggcgtctggatgaagatctcaccgcagcagaagtgcgctaccaacggcacgggggttttctgcacatactacatcgggactttcggcgggaatagcgccaggtgcttcctccaggagatcggcttcaacgacagcgggaagcaggagaatctgaagtcgatctgcgagaagattgcggactctaacgtggagggcatcccggcttcagatattgtggccgagctcgtcgagaagacccagctcccagtcggcagcctggggatccaggaccctatctacatggacggctgccaggatttctctcccacgtcactggagaaggtcatcaactcaattgaggatatcatttccggcgctggggaggaggagtacggccagctcaagtcatccaagctgaggaacaagacactggaggcttactcgctcctgaatatcctggagctggagatctacaagactcggctccagaagctcctgaaccaggaggtgtactactgccagatcgagtccattgaggagatggagtacgagggctgggtctacgacttcgaggtttccaagtaccacaatttcgttgctaacaacatcatttgccacaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3137 - DNA, 4997 bp, Artificial Sequence
  Synthetic Construct, AS-137 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcggttacgggggatactgaggttactattaggcggaatgggcggattgagttcgtccctattgagaagctgttcgagcgggtggatcaccgggtgggggagaaggagtactgcgtgctcggcggggtcgaggctctcacactggacaacaggggcaggctggtctggaagaaggtcccatacgttatgaggcacaagactgataagaggatctaccgggtgtggttcacaaactcctggtacctcgacgtcactgaggatcattcactcatcggctacctgaatacctccaaggttaagccagggaagccactcaaggagaggctggtggaggtcaagccagaggagctcggcgggaaggtcaagtccctgatcaccccaaaccgccctatcgccaggacgattaaggccaatcctatcgcggttaagctctgggagctgattggcctcctggtgggcgacgggaactggggcgggcagagcaattgggcgaagtactacgtgggcctctcgtgcgggctggataaggctgagatcgagcgcaaggtcctcaacccgctgagggaggcctcggttatttctaattactacgacaagtccaagaagggcgatgtctcaatcctctccaagtggctggcggggttcatggttaagtacttcaaggacgagaacggcaataaggctatcccgtctttcatgttcaacctcccccgggagtacattgaggctttcctcaggggcctgttctccgctgacgggaccgtgagcctgaggaggggcatcccggagattaggctcacgtcggttaaccgggagctgtctgatgcggtgcgcaagctcctgtggctcgttggcgtgtccaacagcctgttcaccgagacgaagcccaatcgctacctggagaaggagagcggcacccactcgatccatgtcaggattaagaacaagcaccggttcgccgaccgcatcggcttcctgattgataggaagtctacaaagctctcagagaacctgggcgggcatactaataagaagagggcgtacaagtacgacttcgatctggtgtacccgcggaagatcgaggagattacgtacgacggctacgtctacgatattgaggttgagggcacacataggttcttcgctaatggcattctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3138 - DNA, 5096 bp, Artificial Sequence
  Synthetic Construct, AS-138 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgaccgctgatacttacgtttggacagatcgggggctggagacagtcgctgaggttttcgggcgggcggggctccctctctcatccactagcagggttaccgacgtgagggaccgggatatccgggtggtcaacgagaagggcgagctggagcaggtggctgctctcacgcataatgggaggcagccagttgtgaggatcacagtcgcttccggcaggcaggtcacggttacacggaaccaccctctgcgcgtcatgaatgacgatggcttcattgtttggagggaggctgggcagctgagggagggcgacgtgctcgtctccgctgccttcggcgctgtccaggctgcttcgggcgggggcctctctgaggacgaggctgttctcctggggtacctgaccgctgctggcagcctcgatccagctgggcatgtgtgcttcaccacgacagacatcgagacaggcgctgagttcgctgctctggctgagtggctcctggacactaccgtcactgctgttccaggggatggccaggtggcctacgtgctgtccgacccagctgctaggcacacgctcgctgagcgctacggcgtggattacgctgctgctgctcggatcccgcagtgcgtccgcactgctggcgacaagatgcagagggctttcctcgctgctctgtacaccgctgctggctggactgacaccagcgctgccgttgggctgaggacggcttcggctccactcgcgagggaggtgcagtacctcctgtacgggctgggcatcccagccgacctcgataggtctcacgggaacggccagcatccttgggctgtgaccatttcaccagctgctgctccaaggttccacactgaggtcggcttccgcaccgctcagcagtcgccacagacggggctgcatgagccaacaccacaggtggaggctatcccaaatctcacgggcctgattcacgctctcagggactcaatcggggatcgggccgagtccacagacgatccattccctgctgctagcgggggcgcttacgacagggatcaggttcgccgcgtgatcgactgggctaagaggaggactgatgaggctccagctaccgctaacgctatcctcggctacctgacgcagctcacagatgccaggtacacgtacgagccaattacagccgtcgaggacgcgggccagcagcctaccttcgacctcatggttccaaggactcatagcttcctcgccaatggcattctctcacacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3139 - DNA, 4901 bp, Artificial Sequence
  Synthetic Construct, AS-139 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcatgcactacgacacactcgtgacactcgctgacggcacacaggagaagatcgggacaatcgtggaccgcaagctggacgtggaggtcctgtcgtacgatccagagaccgacaggatcgtgccaaggagggtggtcaactggttcgataatggcgccgcggaccacttcctgcagttcactgtgggcaggtctgggaagccaggcggggctcagttcaccgctacgccaaaccatctcatcaggacccctggcgggtggagggaggctggcgagctcattgctggggacagggttctggtgcacgagccacattacctcaatgagcagcagaggcaggttgtgtacggctcgctcatgggcagggggacgctggtcccagataggcacggcgggcctggcgttcacttctgcatggctcatacagccgagcaggctgcctacctggactggaaggtctccctcctgggcaacattgcccactcacgcaccgctgaggcttccgctacggtcggggttgagttcacaccgatgcccgagctcagcgagctgcatagggtcgttgatttcggcgacgggcacacccatctcacgtgggagttcctcaagcagctgacgccactcgcgctggctgtgtggtacctcgatgcgggcacactgactatccctcagtccgggactgacgatgacgccagggtgcagattgacgtcgagaccctgtcgccaggctctcggcagaggctcgtcgagtacctgagggatacccacgagctcgacgctgctgtggtccagcagggcgctgacgcgaggtctctcctggagttcacaccagctgctaccgtgcgcttcctggagctggttgcgccatacgtgcctgagtcaatgtccagcatgctcctggctcagttcaggggcaggtgcagcgtcacgccagagtactcggatccagtccagaggctcgttgctgctccagtgctggacatccaggtgaagcccggcagcacacgcaagttcgacattgaggttgagggcaatcataactacttcgtggatggggtcatggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3140 - DNA, 5441 bp, Artificial Sequence
  Synthetic Construct, AS-140 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcgctgctgcctgaggagtggattccgctcgtggagaatggcaaggttcggctgcatcgcatcggggagttcgtggacaagctcatggagaccgacagcgagctcgtcaagcgcaacggcgataccgaggtcctggaggtgcgcgggatcagggctctgtctttcgaccggaagtcaaagaaggcgcgcgtgatgccggtcaaggctgttattcggcaccgctactccggcgatgtgtacgagatcgtcctcggcagcgggaggaggattaccgtcacggaggggcattcgctcttcgcttacggcgacggggagctgagggaggtgacaggcggggagatcaaggctggcgatctcctggctgttccaaggagggtgaacctgcccgagaagaaggagcgcctgaatctcgtcgagctcctgaggaggctcccagaggaggagacaggcgacatcattctgactatccccgtgaagggcaggaagaacttcttcaaggggatgctgcggacactccgctggatttccggcgaggagaagaggccaaggactgctaggaggtacctggagcacctggagggcctgggctacgtgcgcctcaagaagatcggctacgaggttaccgacagggaggggctggagaggtacaggaagctctacgagaggctggtggaggcggtccggtacaacggcaataagcgcgagtacctcgtggagttcaacgctgttcgcgacgtgatcgccctgatgccggaggaggagctcagggattggctggtcggcaccaggaatgggttccggatgaggcccttcgtggagatcgaggaggacttcgctaagctcctgggctactacgtctcggaggggaacgccaggaagtggcggaaccagaagaatggctggtcttacacggtgaagctctacaacgagaatcagcgcgtcctcgacgatatggagtccctggcggagaggttcttcggccgcgtgaagagggggaagaactacatcgagattccaaggaagatggcttacatcattttcgagaacctctgcggcaccctggccgagaataagcgggttccagaggcgatcttcacgtcgcctgagtctgtgcgctgggccttcatcgagggctacttcattggcgacggggatgttcatccttctaagagggtgcggctgtcaacgaagtccgagctcctggtcaacggcctcgttctcctgctcaatagcctgggggtctcggccatcaagattcgccacgactcaggcgtttacagggtttacgtgaacgaggagctcccattcacagattaccgcaagaagaagaacgcgtactactcccatgtcatccctaaggagattctggaggagactttcggcaaggtgttccagcggtccgtcagctacgagaagttccgcgagctcgtgaagtccgagaagctggacggcgagaaggccaagaggatcgagtggctgctcaacggggacgtggtcctcgataaggtcctggaggttaagaagcggccatacgagggctacgtgtacgatctctctgtggaggaggatgagaacttcctcgctggcttcgggctgctctacgctcacaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3141 - DNA, 4835 bp, Artificial Sequence
  Synthetic Construct, AS-141 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttcctaccatcatgatttcgagctgctgctggctgacgggcgcaaggttaagatcggggagctggtggacaagctgattgagaagaatcgggaccgcgtcatcctgggcaaggataccgagatcctcccggttgaggacattgagctcctggcctacgatctggagaagagggagatcgttaaggtgaaggctgaccgcgtctcaaggcacaaggctccagagcgcttcatcaagctcaggttctccaatggccgggagattaccgtgacgccggagcatcccgtcatggtttgggagaacggggagatcacagagaagccagcggagaagatcactcctggcgatattgctctcggggttctgcgctacccgattcaggtggacggcaagttcaaggagaggtaccgggatatgagggaggcggaggactaccaggattacctgtactcccggggcgtggtcagcaagatcaagcgcaccgggatctacttcacggtggagaaggctaggagggctctcccgcgggagctggtcaagcccctcatcaacgctggcaagattctcagggttacacagactccaaaggagcgggcgagcttcaatcagaagctggtccgcgagaacatcattgaggggtacctccagaggatcattgagcggatggacgagctggagaggctgtcgcgcgaggatccagctaaggctctggagctcctgcctaagacccagctctactacaagtacggcatcacgtacgggaagctcaagaagctggctgaggctcgcaactcctgggctgagggcatcattcagtcggcggtggctgagcgcatctctctggccaagagggagctggaggagttcttcaagtggtggaacgcgaatgtcaacttcctgaaggtgaagtgcgtcgaggagatcaagaacgaccgctgggagtgggtgtacgacgttactgtggagcctcatcatctcttcgtttcgcatgggctcgttctgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3142 - DNA, 5039 bp, Artificial Sequence
  Synthetic Construct, AS-142 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcatgcatcctgacacatacgtggttactaagtcgggggctaagaaggtctctgagctgactgagggggatgaggtcctgacacataccggcacgttcaagaaggtcatccagccactgaggagggagcacaaggggcgcctcctggttatcaaggcctacggcaccgtgcctgtcaagattacgccggagcacatggtttgggtggtcaagcagatcaggcacaagtcccattacagcgatgggcggcaggtcatttggtgggagttcgagggcccagagtggatgacggctcaggagctgaaggagcgcctggagtccgagacagacccaaaggtgagctacatgctcctgcagccaatccctgagccgtccgtggacgcggataagattcctctgaggaaggaggtctacgttgtgaaccagcacggcaagacagacaagctccatccgtccgtgaagcggactcccgagtacctgccactcaacttcgagaccgctaggctgatcggcctctggattgctgaggggtcaacttccaagaacggcgtcatcaagttcgacatttccagcaatgaggaggatctgacggagttcatcacaggcactattaggaagtacttcccgcacgctaagatcgtcgttaaggaccatgagaggaacaggaggacggtccggttctgcaataagcgcttcgcggagtggctcagggagaacatcggccacggggctgataataagagcattccgcccctcctgctcctgaacaagaatagggaggtgcgcctgggcctcctgagggggctcatcgagggcgacggctacgtgcgcagggagtcgcagcgcagggcgaactacatcagctactcgacagtttctccctcactggcttaccagctccagctcctggtggcttcgctgggctacacctcgtctatccacaggtctattcggacagagggcatcgggaagactaggaagcccatctacgatgttaaggtgtcgggcaagtcttactactcactcctggaggagctcgggttcgaggtcccacagaggggcaacaggacctacaacgttaatcgcacgtggaagaattacctcctgctcaaggtgaggtccatcgaggaggaggagtacgagggcgacgtttacaatctggaggttgagggggatgagtcaggctctgtgggcttcatcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3143 - DNA, 5468 bp, Artificial Sequence
  Synthetic Construct, AS-143 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgctgccggatgagaaggttattctccctgagcatgggcctattacactcaaggggctcttcgatctcgctaaggagacagtcgtggctgacaacgagaaggagatccgcaagctgggcgccaagctcaccattgtgggcgaggatgggaggctcagggtcctggagagcccatacgtttggaaggtgcggcaccgcggcaagatgctgagggtcaagctcaagaactggcactcagtgtccgtcacgccagagcatcccttcctgaccacgcggggctgggtgcgcgctgaccagctcaagccgggggattacgttgcggtgcccagggtcatccatggcaacgagtcagacgagcggttcgtctccttcgtttacgagaagctcaagaatgatgagctgatcgcgaagctccgcggcgaggtgctgtccaagatttccagcgagttcaagggggacagggcttacaaggttgagaggaacgtgttccggtgggaggacatcgagcgcctcaatctgtgggatgaggtggagagggtcgccttcaccccaaggatgcacaggagcggcaagccactgcattacgtgaagctcccaaggtcgcctgaggagtgggaggctttcttctacttcgctggcgtcatgttcggcgacgggtcccaggataagatcgccaacaatgacgtcgaggtttacgaggagctcaagaagctgtctgttctcggcgtggctgtcaagagggtggagaggacaacttcatacgagatcgagctcaccaacgggaagaatgctctcctgaggctcctgagggtgctgttcgagtacccggagcggcagaaggcgaagtccattagggttccacggatcctgttcattgctcctcgcaagtatgtgtcccgcttcctcaggggctacttcgacgcggatgggcacgtcagcctgaaggacgcgaggatcgaggttacgagcgcttcgcaggagttcctggaggatctcagcctcctgctcctgcggttcggcatcgtgtccaagatctaccgcagcgactacaccacgctcgttatctcgggccgcaggaacctcgatctgttccggcgctacattgggttctctgtcaagaataaggccgaggcgctggagaaggccatcaagaagtcaaggcggtctgagtcataccccattttcgaggagctgaagaggctccggctcctgttcggcttcacacgcactgagctcaacagcaatgtgccattctacgggaagtacgagtcggaggaggccccttcttacgagacactgatgaggatcctcgacgcgattgagaagggctcgatcaacctggataagaagattgctgtcctggaggggcgcatcagggaccataattacattaaggccttcgagaaggacggcctgatcaaggatgggaagctgactgagctcggcagggagctcctggaggtctggaggaacagggagttcgactcgtctgacgtcgattacatccggaacctggcggagaatctcgtcttcatcccggttgaggacattgaggagttcgagtacgagggctacgtttacgacgttactacagagactcataatttcgttgctaatggcatcctcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3144 - DNA, 5405 bp, Artificial Sequence
  Synthetic Construct, AS-144 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtttcgggggactcaaagatcctgacagggaaggggccagtggagatcgggcggctgaactctaacatgatcgcgggcatttggcgcttccagaccgagctggtgcggttcgaggagccacaccgcgttgagtaccgcagggagggcgtgaagatccgcacgaggctcgggttcgagattaaggccaccaaggagcataagttcctcacggtggacgagaacggcgagctgcgctgggtcgaggcttggaagctcaaggagggcaactgggtcggggtggtccggcgcctgccatctcctaatgtgaaggtctcaatcctcgacctcctgccgcccaacgcctacctcaagctgaagggcgagttcctgagggagctcaagctgtcgatccaggcgaagttcggctctattaggacatacgccaagaagaagcgctggtcagagtcctacctcgtcaagcagctgaatggcgtttacccgttcaggtgggagaggctctccgctgtgctgaaggacctcgatctgcgcatgacagagaacgacgtcgagaggatcacttccgataagggcaagtacagcctcccgatcgagttcaccccctcaatggctaggctcctgggcttctggatggctgacgggtcctggaagggcgggaccctcacgctgttctccagcgataggaagatgctggagaagtacaaggagctgtgcaaggaggagttcggcgttgtggggcggatccgcatgctcaacgagtctacatactcactggagatctctttcaatctcctgccggctattttcaagaacctgacaggcaatactgagcgcaagagcaagctcgggactttcccatccatcatctacagcctgcctgaggagcacaagagggagttcctcgcgggctacttcgacggcgatgggttcctggaggttaagggcgggagggtgtactcggctggcttctctaccttcaacaagaggttcgcggagggcatccgggacattctcctgcagctcgggatcgtgtcgtctattagggcccgggagtacgatgaggtccagaagttcaagggccgcgttatccccaagaagggggcttcatacacggtttccgtgctcggcggggagtacctgaagaggttcttcgacgccgtccgcccatggaggtcggattacgagggctgggaggggatgtacaacgagggctacagcaattcggacgtcgttcccaacctcggcaagcgcctgaggagcatcagggagaggctgggcattagcgcttaccgcatgtcgaagatggggttctacaatccagtccgcgttgagctgggcgagagggagatctccaggcggaacctcaggctcctggtggagttctacgagcgggtcgcgaaggagaagcgcgtggaggacgtcctggaggagctgagctacctcagggagctggctgagggcgacgtgttcttcgatcgcatcacgtcggtggagcctgcctacattgatgtcgcgtacggcatcatcaactcggagacagagaactacatcgtggagggcttcatttccaagaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3145 - DNA, 5438 bp, Artificial Sequence
  Synthetic Construct, AS-145 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttctattctgcctgaggagtggctgcctgttctggaggagggggaggttcatttcgttaggatcggggagctgattgaccgcatgatggaggagaacgctggcaaggtcaagagggagggggagaccgaggtcctggaggtttcaggcctggaggtgccgtccttcaaccgcaggacgaataaggcggagctgaagagggtcaaggctctcatccggcacgactactctggcaaggtgtacaccattaggctgaagtcaggccggcgcatcaagattacgtcagggcattccctgttcagcgtccggaacggcgagctcgttgaggtgaccggcgacgagctgaagccaggggatctcgtcgctgttccaaggaggctggagctgccagagaggaaccacgtcctcaatctggttgagctcctgctcggcacaccggaggaggagactctggacatcgtgatgacgattcccgtcaagggcaagaagaacttcttcaaggggatgctcaggacactgcggtggatcttcggcgaggagaagaggccaaggactgctcgcaggtacctcaggcatctggaggacctcggctacgtgcggctcaagaagatcgggtacgaggtcctggactgggatagcctcaagaattaccggcgcctgtacgaggctctcgtggagaacgtccgctacaacggcaataagagggagtacctggttgagttcaattcgatccgcgacgccgtggggattatgccgctgaaggagctcaaggagtggaagatcggcacactcaacgggttccggatgcgcaagctgattgaggtcgatgagtccctcgccaagctgctcggctactacgtgagcgaggggtacgcgcgcaagcagaggaacccgaagaatggctggtcgtactctgtcaagctgtacaatgaggaccccgaggttctggacgatatggagcggctcgcgagccgcttcttcggcaaggttaggcgggggaggaactacgtggagatccccaagaagattggctacctgctcttcgagaatatgtgcggggtgctcgctgagaacaagcgcatcccagagttcgtcttcacatcacctaagggcgttaggctggccttcctggaggggtactccagcgctatggctacctccacggagcaggagactcaggcgctgaacgagaagcgcgctctggccaatcagctcgttctgctcctgaactcggtgggcgtctctgctgtgaagctcggccacgactccggggtttacagggtgtacatcaatgaggagctgccattcgtcaagctcgataagaagaagaacgcttactacagccatgtgattcctaaggaggtcctctcggaggtcttcggcaaggttttccagaagaacgtgtccccacagaccttccggaagatggtcgaggacggcaggctggatcctgagaaggctcagaggctgtcgtggctcatcgagggggacgtggtcctcgatcgcgtcgagtctgttgacgtggaggactacgatggctacgtgtacgatctctctgtggaggataatgagaacttcctcgtgggcttcgggctcgtttacgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3146 - DNA, 5276 bp, Artificial Sequence
  Synthetic Construct, AS-146 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3147 - DNA, 5297 bp, Artificial Sequence
  Synthetic Construct, AS-147 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttacccctgacacactcgtttcgctcgctgacgggcggattatggagatcaaggatgcggtggagaagtcggagggcaatctgctcagcgtgaacggcctgaagccgaaggaggccaaggcgctcaagttctgggagatcgactggaacgggcccctcaaggtcatcaagctgaagaatggccacgagattaaggccacgccagaccatgggctcctggtcatgagggagggcaagctggggtgggtttcggcgaagaacgtgagggagggcgactacgtcgctttcgcttacaataccggccacagggggagggatgagtacacgctcctgaagctcatgatcaagctgggcattaccgacgtgatggtcgagctcgatgaggagtacttcaacgagaaggttgcccctatcgtgagggagcggatttccacaagcactaagtacaagtacctgaggaggagggtcctcccactgtacctcctgcaggagtggggcctggacgattacgaggcccatgttaagtccctctacaggcagagggctggcagcaagccaatccccaatttcaagctcgacggcaggttctggtatgtgttcgggctcgttctgggcgacgggacactccgcgatagcaaggtgctgatctcgcagactccactcaaggacgtcaagtccgttctggaggatgtcttccctttcctcagggttttcgagaccacgaaccaggttggcttctccaactccatcatcgctgaggtgttccgcaggctcggcgctaggaaggggaagctccacccactggtcttcggcctgagggaggagtacatcaacgcgatgattgctggctacttcgacaccgatgggacgttctctatcctcaacgacaggaagggcccaaatttccgggggatcctgacatcaaagcggggcgatgtgctccgcatgctgtccgtctacctgtaccagatcggcattatgaactacctcaggagggacgagaggaccggggtgtgggatctgatcatttcaaatcgctccctggagaagttcagggagaagatctacccgtacctccggattaggcgggctcagttcgacgaggcctactctgtctacagggcctcacgcagggctttcgagggcgatctcctgccagtggcccctgtcttcggcaagctgaagttcaagaacgggacaaagaatcgcatcctcaaggagactggcattgacgtgtggaactggctgaagaggccagagggggagatcccccgcgataagctctccaaggtcctggagtacgctgaggagtcgcccgagaaggagttcctcaagtctctggtggaggcgggcgtcacctgggttaaggtgaagggggtggaggaggagctgtacacgggcaagctctacgacttcacaactactacggagaatttcctctcaaatggggctgtttctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3148 - DNA, 5192 bp, Artificial Sequence
  Synthetic Construct, AS-148 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcatcgatggcaacgctaagattattttcgagaatgacggggaggagcatattatgacaatggcggagatgtacgagcgctacaaggatctgggcgagttctacgacccggagtacaaccggtgggggatcaatgtggaggaggttccggtctacgtgaagtcattcgatccctccaccaaggagattacgaagggcaaggtgaaggtcatctggaagtacgagctcggggaggacgttcccaagtacgagatcaagacaaacaagggcactagggtcctcacctcgccatggcaccctttcttcgtcattacgcaggatctgaagatcgttgagaagcgggctgatgagctcagggagggcgacatgctggtcggcgggatgccatctgacgatgactacgagttcctcctggactactggctcgccggcttcattgcgggcgatgggagcatcgacaagtaccgctcgcacgttaagggccatgagtatgtgtacgatcggctgcgcatctacgactacaccacggagacgctcggcatcattaacgaccacctggagaagacattcgggaagaggtactccctccagagggatcggaatatccactacatcgacattaaggccaagggcattactagccattacatcgagctcctgcgcggcatcaccaacgggattccgcagcccatcctgaaggagggcaggaatgctgtgctctctttcatcacgggcctgttcgatgccgaggggcatgtcaactcaaagccaggcgtggagctcgggatggtcaataggaagctgatcgaggacattacatactacctcaacagcctgggcatcaaggcgcgcatgaggaagaagcctcggaaggatggggtggactacgtcatgcacgttgaggagtactccagcctcctgcggttctacgagctcattggcaagaacctgcagaactccgagaagcgcatcaagctggaggagctcctgtctaagcataacggcgggtcattcggcctcaccctgtccttcgaggacttcaaggcgtggtcgtctaagtacggcgtggagttcaagacgaacgggtcccagacactcgctatcattaagaatgagaaggtgagcctgggccagtggcacaggagggggagggtctcgaaggctgtcctcgttaagatgctccggaagctgtacgatacaactaagtccgaggacgtgaagcgcatgctccatctgattgagggcctggaggtggtcaaggagatcaacgtcactaatgagccaaagaccttctacgacctgactgtggagcgctaccagaactacctcgccggggagaatggcatggttttcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3149 - DNA, 5363 bp, Artificial Sequence
  Synthetic Construct, AS-149 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgcatccggactcactcattcctacgcctcagggggttaagcgcatcaaggagctgccggagaagggggaggtcttcgctctcgacttcgatctcaagctgtcacgggcgaggtacaggctcctggagagggacgctgatgagcccatgtacaaggtgacactctccgacaggactgagctctacctgaccgcggatcacccggtcctcgtttacagggacgatcagctgatcttcgtccccgctgaggagctccgggagaacgaccaggtggtcctgttcattaatcgctcagagtactccccaaggaccgagtcgcctacgctcctgggcttcctcctggagaacgccacctctatgaaggactacatcctctacgatccagagttcggcggggtgctgaggaatcgcattaaggacgcgggcctcaagactgagatcctgtggaggttccggattcgcgagcccacctactacaagtacctccgcggcaagatgccggttcccatcgtgaggttcctcctggaggagggcgttgtgagcattgaggagctccgggaggtgttccgcgggttctcgtactctacatcactgactccaatcagcttcgagttctcggaggagttctggtacctcttcggcctggtcgctggcgacgggcacctggctaagaagggggctatcaccattccagccaaggaccgcaccgaggatacggtcaaggcggttaaggagatcgctaactccctccaggtgcctttcgccttcgacgagaagtacaagatgatcattctgcggtccaagagcctcacgaggctgttcgagctcctgggctgcccgtacgggaacaagacagagatcttcaggattccgggcgagatcatggcgaagccagagtggatggctgcgttcctcgctggctactacgacgcggatggccacatcgggacaaagccaactggcgggaagaagtcgcattctcctcagatcgtcctgacgagcaagaaccgcatggccatctacacagtcaagcagatgtggcagctcctgggcgttgggacgtacctctgggagaagaaggacaggaacggcaatttcatggcctacgagctgaaggtgtactcccgcgacgcgtggcggttctacgaggtcatgaagaaccacctccgcatcaagaggaaggacctggagcatgtgaaggaggtcgctattaggaagcggaaggcctactctcaccattactcagttctcaatgtgaagtcttgggagggcaagatcaagtccagcaacgttctgtggaagaagttcgacatgtccaatcagaccgctcacggcagggggatcagcctcgacaagctgcagcgcattgtcgattacctcaccgacacggatctgcgcaggatcgcgatgggcgatgtctacgtgctggggatcaggtccattgagaagttccattaccggggcaaggtgtacgatctcgtcgtggatcagtaccacaacttcattgctaatggggtcgtcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3150 - DNA, 5099 bp, Artificial Sequence
  Synthetic Construct, AS-150 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgcctgcgcgggctagggtcgtggattggtgcacagggcgggtcgttcgggtcggggagatcgttaggggggaggctaagggcgtctgggtggtctccctggacgaggctaggctgaggctcgttccaaggcctgttgtggctgctttcccaagcggcaaggctcaggtgtacgctctgaggaccgctacgggcagggtgctggaggcgacagctaaccacccagtctacactccagagggctggaggccactggggaccctcgctcctggcgactacgtcgctctgccaaggcatctctcgtacaggccatctctgcacctggagggccatgagctggatctcctggggttcgctctggctgagggccacctccgccatccatcgggcgtgtacctctacacctccagcgaggaggagctggctgccatggaggaggctctcagggcgttccctaatacgcggatccgcgtcgtttggaggaggggggttgctcacgtctacgtgggcagggtggacaggaggcaggaggctggcgctgtggcgttcctcaggaggatgggcctcctggggctggatgcgaagacgaagaggctcccagaggctgtcttcggcctgccaccagaggaggttgctaggttcctggggaggctctggacaggcgacggcggggtggatccaaagggcaggctgattcactacgctactgctagcaaggagctcgcttggggcgtccagcatctcctgctcaggctgggcctccagagcaggctggtggagaagcggttctcgggcgggtacaagggctacgctgtctacctgctcggcgggctggaggctgctaggaggttcgctgagacagtggggccatacctggtcggcaagcggaggcaggacctggaggctctgctcgcttcatgggagaaggctggcaggtccaccggggatgttctgccactcgcgttcctggaggaggtgagggctgctgttgctgaggtggctcagggccaggtggctgacctgctcagggaggccggcctcgcggaggggctgctctgcctgggcagggggaggagggggctctctcgcgccaccgtcggcaggctggctgccctcacggggtcactggcgctgctccggctcgcggaggctgaggtttactgggatcgcgtcgaggcggttgagccgctcggcgaggaggaggtcttcgatctcactgtggagggcactcatactttcgttgcggaggatgttatcgttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3151 - DNA, 5144 bp, Artificial Sequence
  Synthetic Construct, AS-151 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctgcatccggacactctcgttcataccgatcgggggactctcaggctgcgggagctcgtggaccctttcaggcggggctggcagccgcacaccctgagcgttgctacggacgagggctggaggccatcgccagagggctacaacaatggggtggctccaaccctcagggtggtcctggagaacggcctggaggttcaggggacactcaatcataagctcaaggtgctgcgcgaggatggcactagggagtgggtcgagctccaggacctgaggccaggcgattgggtcatctgggttctggacgagcacaccggcacgccagtccagctcgctccactggatgagccactccatcctaacaccacgccaattcgcacacctgaggtgctgactgaggacctcgccttcctcctgggcttcttcttcggcgaggggttcgtgtcgggcgataggatcgggttctctgtccacgaggaggagccaatgcgggaggaggcgaagaggctgttccgggagctcttcggcctggagctgagggaggagaggaagccaggggaccgctcagttaccctggttgtgcggtcccgccctctggtgacgtggctccgcaagaacggcctcctgaaggggaaggcgagggagctggaggtcccgcgggctatcaggcagtccccaaggcctgttctcgctgcgttcctcaggggcctgttcgaggccgacggcacaattactgcggggtacccaatgctgacaactgcgagcaagcgcctcgctcaggatgtgatggtcctcctgggcgggctgggcattccttctaagctcctgaggtacaatccactcccaggccgcttctcaaaggctgagcattacggcgtccgggtcgttacggctaaggggctggagaggtacctggagcggatcggcgtgccaaaggggtcgcgcctggaggcgctgcacggcattaagccagacgtccgcagggagtccagctggccactgcctcatgctgagggcctcctgaagccactcctgaccgtgacggagaagggcaggaaggggtacgctagcccatacacaccactgcgcaaggacctcctgaggtacctgaggggcgagaggcagctcacagctactgggtacgccatggtcctggagaaggctcaggatctcggcctggaggctgagccattccccttcaacgagtactacgttagggtggcctccgtggagccgggcggggagatcctcacgctggatctctctgtggagggcaatcatacatacctcgccaatgggctcgtctctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3152 - DNA, 5051 bp, Artificial Sequence
  Synthetic Construct, AS-152 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgtggggtctactcgcattccgacggagcgggggctggttcctattgaggagctcgctagggagggggggtctttctacctggtgactgacaacagggctccgttcggcgggaggggcgctccactcccaggccacgggaccgccgtcaggaaggccgttcgggcgttcttcacgggcgtcaagccagtggtccggctgaggacaagggagggcctggaggttaccctcacgccagatcatctcctgctcacgccagagggctacagggaggctgggaagctgaggccaggcgagaagatcctcgtccagtccggcgaggggctgttcccaaaggaggagagcctgcctgctcaggctctcgctgttgtgcacgagagggtggcgacggctggcgggaggggcgggaggggcagggctgacgtccgcgcccagtacaggaacctccccacacgctggtcaagggagctgggcgttgctctcgggtggctgctcggcgacgggtacctgagggaggatggcgtcgggttctacttctcccggaaggacttcgctgatctggcctggctcccagacctgctccgcgattggttcggccctgggacactccaggagactcgcagcaacaccttccacctgcatttcaataggatcccggctgagttcttccaggctctcggcgtgaaggctgcgcgggcaactgagaagagggtcccagagtcgctgttccgggctcctcgcgaggctgtcgttggcttcctgcaggggctcttctctgcggacggctcagttcagattaacgagaataagcaggatgctaccgtgaggctggcctccagctcgctcgctctgctccaggacgtgcagctgctcctgctcaacctgggcatcctcgggaagattcacaagaggagggaggctgctaggaaggctctcccggacggcaagggcgggctgagggagtacccagtcgctcctcagtacgagctgattctcggcggggagaatagggatcggttcgccgaggtggtcggcttcctccaggaggagaagcagagcaagctgctcgcgttcctgaggcataggccgaggggctcgtacaggaagcccttcctcgctaccgttgcttctgtggagccagctggcgaggcgcccgtgtacgatctcacagagccagttacacactcgctcattgctaatgggctcgttgctcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3153 - DNA, 4388 bp, Artificial Sequence
  Synthetic Construct, AS-153 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgtttcgggggagacgccagtctacctcgctgacggcaagacaattaagatcaaggacctctactcatctgagcgcaagaaggaggacaacatcgtcgaggctggctccggggaggagatcattcacctcaaggacccgatccagatctacagctacgttgatggcacgatcgtgcgctcccgctcccgcctcctgtacaaggggaagtccagctacctggtgcgcatcgagacaattggcgggcgctcagtgtccgtcactcccgtccataagctcttcgttctgaccgagaagggcatcgaggaggttatggcctcgaatctcaaagtgggggacatgattgctgctgtcgctgagagcgagtcggaggcccgggattgcggcatgagcgaggagtgcgtgatggaggcggaggtctacacctctctggaggctacgttcgaccgcgttaagtcaatcgcgtacgagaagggcgacttcgatgtgtacgatctgtcagttccagagtacggcaggaacttcattgggggggaggggctgctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3154 - DNA, 4286 bp, Artificial Sequence
  Synthetic Construct, AS-154 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctctcaggggagactgcggttatgacggtggagtacggggctattcctattcggcggctggttcaggagcggctgatctgccaggtttactcgctcgacccacagggccacctgtacacgcagcctatcgctcagtggcatttccagggcttccgcccggtgtacgcgtaccagctggaggacgggtccacaatttgcgctactccggatcaccggttcatgaccacgagcggccagatgctgcccatcgagcagattttccgcgaggggctggagctgtggcaggtggccatcgctccaccaggcgctctcgctcaggggctgaagccggccgtccagatgtcctgcatgaagattgtgggcaggaggctcgtcgggtggcaggctgtttacgatattgggctcgccggggatcataacttcctcctcgctaatggggctattgctgctaattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3155 - DNA, 4751 bp, Artificial Sequence
  Synthetic Construct, AS-155 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcgttaccgctgacacatgggttactaccgctgaggggccaaggcaggtggaggagctgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcggatttctgcgagggcatcctgagggggctcttcgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3156 - DNA, 5198 bp, Artificial Sequence
  Synthetic Construct, AS-156 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggggactgaggtcatgatgcacgacggctctgtgaaggctattgagactatcgaggcgggggaggctgttatggggaccgacggccagccaaggaaggtggtcggcctccctcgggggagggaggtcatgtacaaggtttcccagaagacggcgcaccgggtgcataagaccgacgagacgcgcgccgctccagtcgctctcttcgagtacaactgcaatgccacacacaagctggttgtgaggactcctcggagctgccgctcgatcacccgcaagatgcagggcgttgactacaacgaggtcatcttcttcgacctcaagaagaagaagctggaggacggccgcgagatcgagattgtcaaggaggtttcgaggtcttacccagctgctgagggcgctgagaaggctgctcagatggtgaaggactactacgatgccgcgcgcgggaaggagttcttcgagtggacaatcgaggcgagggatgttagggagctcggcgctcacgtgaggaaggctactcatcaggtgtacgccccagtcctgtacgagagcgacttcttcttccattacgtgaagaactcgaagttcgctctgaggtctgaggcctcaacagctctcgcctacctcctgggcctgtgggtcggcgacgggctctccgatagggctgtgctgtccgtcgacagcgaggattccagcctcctggagcgcatcactggctacgccgacattctcgatctgagcgcggagtacaaggaccgcgagatcccgaagagggcgaagaccgtctgcctctaccccaagacgatccgcggcaacgatattcgcaggaacctgaatacggacaacccggtctggaatgccatcgttgacctcggctacctgaaggatggggttaagaatgtgccctcgtacctcttctcagactccatctgccacagggaggtgttcctcgcgggcctgattgactctgatgggcatgtccggggcgacgatgggctgtcagttacaatcaagactattcacaagaccgtcatggagggcacggtggctgtcgctaggtcgctcgggctgatcgtttctgtgaacaccgaggaggcgaagattgacaagaacgatgtgaatcaccgcttcgtctacgctatctacatttcaggcggggacgctctcctgtccgtgctcgctcattgcgctgctgcgaagaagttcagggctccaccatccaatgaggtcgttcgggggctcaagaaggtcttcttcgagatggaggagctgaaggaggacgattactacggcatcacgctcgctaaggagtcagaccatcagttcctgctcgccaatcagctcgtggttcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3157 - DNA, 5180 bp, Artificial Sequence
  Synthetic Construct, AS-157 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgccaagggcactgaggttatgatgtcggatgggtcaattaaggaggtggagggcattgaggtcgggcaggaggtcatgggcaaggacggcaagccgcgggaggtggtcggcaccccatcggggcgcgagaagatgtacaaggtctctcacaagaccgctcacagggcccataagtccgacagcacgtcggagcggttcggcctcttcgagtacacatgcaacgccactcataagctggttgtgcgcacctctaggtcatgccggccgctcgtcaggaacatccagggcacggactacgtcgaggtttgcctcttcaatatgaccaagaagacgctggaggacggccgcgtgatcgatattgtcgaggagaccagcgatttctacccagcggtggaggggcctgagaaggctctcaggatcctgaaggagtacgctgaggccgacggcgggaaggagtacttcgagtggacaattgaggctcgcgatgtggctctcctgagcgctcaggtcaggaaggctacttaccagctgtcggcccccgtgctcctggagaacaatcacttctctcattacctcaaggactccaacagcgctgttggcaatgatacagtgcgggccctgtcctacttcctcgggctgtggatcggcgacgggatgctcaacaatgccgcgacgttctcagtcgattcccagaacgcgagcctcctgaacaggattaatgagttcgccgaggtgctcggcctgtctgcggagtacaaggactcacaggagccaaagcgggccaagaccgttaacctgtacgcgaaggctatccgcgacgagggcgtgaggaagaacctcgatacgcacaatctcctgtgggacgcgatcgtcgatctcggctacctgaaggacgattcgaagaacgttcctgggtacatttgctcggactctttccagcatcgggaggtgttcctggcgggcatcattgacagcacaggctacgtgtccgatgagaccgccacggtgaagactatcgaccagtccgtcatgacaggcactgtggctgtcgctaggtccctcgggattaacgttagcgtggacgtcgaggttgacgaggatggcgtcgatcggtcattcgtttacgccatctacatggacaggtccgatgctctcctggctgtcctggctaactgcgcttccaacaataagcagatcgaggctccaccacacggcgtgattagggagttcaataaggcttacttcgagatggaggagctggaggaggacgagtactacgggctgactctctcaaatgagtcggatcatcagttcctcctcgctaatcagctcgtcgtgcataattccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3158 - DNA, 4868 bp, Artificial Sequence
  Synthetic Construct, AT-1 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcatcgaggggacggaggttctcactaagcgggggttcgtggatttcagggagctgcgggaggatgatctggtcgctcagtacgacatcgagaccggcgagatttcctggacgaagccatacgcttacgtcgagcgggattacgagggctccatgtaccgcctgaagcaccctaagagcaactgggaggtggtcgctaccgagggccatgagttcatcgtgaggaatctgaagacggggaaggagcggaaggagccaatcgagaaggtcaagctccacccatactccgctattcctgttgctggcaggtacacaggggaggtggaggagtacgacctctgggagctggtctcgggcaaggggatcacactcaagactaggtctgccgttaagaacaagctgaccccgatcgagaagctcctgattgtgctccaggcggacggcacaattgattcaaagcgcaatggcaagttcactgggttccagcagctgaagttcttcttctccaagtacaggaagatcaacgagttcgagaagattctcaatgagtgcgcgccgtacggcatcaagtggaagaagtacgagcgccaggacgggattgcttacacagtttactaccccaacgatctgccgatcaagcccactaagttcttcgacgagtgggtgcgcctcgatgagatcacggaggagtggattagggagttcgtggaggagctggtcaagtgggacggccatatcccgaaggatcggaacaagaagaaggtctactactacagcaccaaggagaagcgcaataaggacttcgttcaggctctctgcgctctgggcgggatgaggacggttgtgtcgcgcgagaggaacccgaaggccaagaatcccgtctaccggatctggatctacctggaggacgattacatcaacacccagacgatggtgaaggaggagttctactacaagggcaaggtctactgcgtttctgttccaaagggcaacatcgtggttaggtacaaggattctgtctgcattgctggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3159 - DNA, 4289 bp, Artificial Sequence
  Synthetic Construct, AT-2 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccagccttactctgcgccggtttcaactcctgatgggcctattcctatcggcaagctcgtggacgctaatgcggtcggggagaaggtgttcgacgcgtcgggcgtcaccaggattgttgctaccacgtgcaacgggaggaagccagtcctccgcatcaggacatccggcgggcacgttctcgacgtgactccagatcatctggtttggcaggtggtcgaccagaccgctggcaggttcgtgccagctggccagctccgggtcggggataggctggagtggcacgacagggccaattccgatgctatggtcgctgcgttcacggctgacagcgctgctgcggctcagccaggccagatcgttgacattctcgcgatcgatgagctgggcgtgatgcctgtctacgatattcagacagagtcgggggagtacctctcagatggcattagggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3160 - DNA, 5084 bp, Artificial Sequence
  Synthetic Construct, AT-3 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacaggggacacaagggtcctcctcgcggacgggcagcgggttcctattcgggatctcgtggggcagacgcctgaggtcatttctgtcaacgctgagggcaggctggagccagctaagaccgacctcgtgtggtccgttggggtgcgccctctcctgcaggtcaggctggcttccggcaggaccatcaggtgcacgccagagcacaggctcaggggcctgtgggattggaaggaggcccgcgacatcagggtcggggataggctgggcattgctcgggagctcccagctccaaaggtgacgaagcgctgggctgagcacgagctggtgctcctggctcatctcgtcggcgacgggtcctacattaagggccagccactgaggtacaccacggcttcagaggcgaactccgaggctgttagcagggccgctgaggctatgggctctacagtgactaggcacccaggcagggggcagtggcatcagctcgtcatctcaggcaacgggaataggtggcacccacagggcgttgggaagtggctcaagcagctgggggtgttcggccagaggagccgggagaagcacctgccacaggaggtgttccagctcgacaatgatcagctggccctcttcctgaggcatctgtgggcgacagacggctcgatcactcaggggtctgctggccgccctaggatctacttctcgacggcctctcggcacctcatccaggatgtcgctgccctcctgctccggttcgggatcgttggccgcacaaagcacattactcatggcgacggggagggctggttcacactggatatttcgggcgctgtccagcagcagaggtacctggagaagatcggggccttcggccaccaggctcataacgctaggagggctctccagcatctgaggggcctcgtcgagaacaccaatgttgacacgctgccggaggaggtgttcaattacatccgggagcgcatgagggaggaggggattacacacaggcagatggctgctctcaggggcactgcttacggcgggagcgctcatttcaccttctccccgagcagggagacgctgctctcgtacgcggacatcctcaacgatcagcggctgcgcatgctcgccaatcagcacgttttctgggaccgcgtggtctccgtggagcccgcgggcgaggaggaggtcttcgatctcacagttccgggcaatgcttgctggctcgcggatggcatcgtttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3161 - DNA, 5645 bp, Artificial Sequence
  Synthetic Construct, AT-4 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgccaatgggacacagctgctgcgctacgatgggacaaaggtcaacgtggaggacgtgaaggagggggatctgctgctgggcccagacggcgggccaaggagggcgttcaacgtggtctccggcaaggaccgcctgtacaggatcaagattgacggggataaggaggatctcgttgtgaccgccaaccacatcctcgtgctgcatagggcgaaggctatgaatacgtctgtctgcttcgaccggtcaaaggagcagcagggcggggctggcgagcagctggacatttccgaggtcagcgccgcggagcgctacgataccgttgagatgacggctgctgagttcgctgctctgcacccacaggagaggtcctggtacagggctatcaggtgcccaggcttcgagctccctgagcaggacgtcccagttaacccttacttcctcggcctgtggctcggggatgagtcccggaaccagagcgctatctactcgaatcacgaggaggccctgcgcgagttcctcgtgagccatgccgcggagctggacatgcacctcgtttaccatggccagtcggcgtactctaccgtgtgcaacaaggatcgcccaacgaataagaggatcggccctgccaaccagacccagacggtcaggccaaccatccggcagacacggcgcactattaggcagcagaggctggctgctgagcacgctgctgctgagtacaccacgcagagggagacagcgtccctcactccgctcctggagtcacccacatccgacaagcatggcctcctgtccagcgtcgagactccagggaggctgtcagattccgttacaactgagctccccatgagcaggtcggcctctgctatgaggtcgatcaggaccgccagcggcctctcggagttcaacgacgtgacgaatgtctcagcttccatgccggatatccagaactctggcattaagaatcaggggaggatcgctaaggtgaccaggcagcaggactctaagggcgaggtcgatttccgccagcagtactcacaggccattaaggacgatctggagctcctggagacggacatcgaggacgatgtggcgtcgtctgacgagattgaggatgtctgcgtcgttggcagcgagaacgagctcatcgggtccgagaagcaggaccagagcggcaggaggaggcagattcacaggctgaggaccgggcataggggctacggggacctctcggacgatgagcaggagcagctcctggacagcgtggtcgagcgctacgcgggcgattcgcggctgaatacactccagcaggagctgagcaagatgggcatcctcaacccagagactgggcctatcaatgacaagaagcgcattccgcaggtgttcatgcagaacagccggtcggttcgcctgtcggtgctcgctggcctcctggactctgatgggtggtacatctaccccgagaatatgttcggcttcgctcagtccgagctgtgccacaaggagctcttctgggacgttgtgacactggctaggagcctcggcttcggggtctggacaaagaagcggatgatgccggaccccactggcaagcgcatgtcaccaatgctggtggcccagatctccggcgatctggcggagattccttgcgtcctcgctcgcaagaaggccatgccgaggctgatcccccagtctcactcattcgccatcaaggacatttctctggagtcagaggcgacggagtgggctggcttcagggtggataaggatcagctctacctcaggcatgactacgtggttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3162 - DNA, 5234 bp, Artificial Sequence
  Synthetic Construct, AT-5 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgccaccatgggagcctatcgtggtcaggcggggggatgaggttcgggttacatcaatcggggagttcgtggattctttcctggagggcgagggcgggctggacatcggcgggctcggctactacaccctgtcgctcgatacccggacgctgaagccagtctggaggaggatccgcggcgttattaagcaccggatccgcggcaggctcctgagggtcaaggcctcaaagggccgctccatcgacctgacgggctctcattcaatctacaggattagcaggggcgggggcctggaggtggtcggctccagcgacctgaggccaggcgattctctcgtgacacctgcttcagtcgagctcccagagtccgccccttcgtctattaacgctgcgagggagctgtggagccggggggtggagggcatcttcgttgtggggctcccaggcgaggctgctgggtacaggggcgtcgagcggtcgcgcggctacgacgggggccacgctatccctctggagacgctcgtggagcgctacggcgattcggtctggtctctggtttcaggcgcgaagctcgctgtttcccggggggctgctggcgaccacccagtgcccgccaccattccgctggatacggggttctacctcctgctcggcttcatcgtgtccgctggcagcgtggacgtcgaggggggccatgttacagtgactctcggcccagggagggagggctacgtgggcgatgtcgttgaggctgtcaactccactgctccaggcgctggggtccgcatttcatccggggcgaggggcatggaggttaccatcaggagccgggtgctgtcggagctgctcgctagggtgttcggcgctgggccaggccctaatcgggacatcccctctattgtcttcagggccccgaagcccatgaagcgggttttcctgaagggcctctacgctgggggcggggtcttcgaccggagctcgggcagcctgatctacgccaccgattcccgcagcctgctcaacggcctcgctctgctcctgctcaatgtgggcgctggcgggtacaggatcgactcgggggattctggcagggctctggcgctcattgtggagaatgctggcaggctcgacgctatcggcgaggtcctggagcacctcggcttccatggcgggagggaggctgttcagggggtgggcgctctggagagggctacagctgggctcgctggccaggctactgtcgctgttcagaggccagctacccgcggcgggccaggcgtggacgtcgcgggggtgacgggcctggagcacctggaggctagcacagagttcgtctacgatctctctgtggagggggatgagaacttcttcgccgggctcgggtggattctcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3163 - DNA, 4964 bp, Artificial Sequence
  Synthetic Construct, AT-6 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctcctgagacactcgtgcataccgctgatgggcctcggcctattcgggatctccagcagggggatctcgttctgggcatcagcggccgctacagggaggttacccacaagttcgtgtacaaccagacggacgctatgctcgccatccgcgtcaagcacgccgttgagccaattgaggttacagctggccatcctttctacgccatcaggggcgtgccactggagcagtcgggggagcgcaccctcaggcagctggagtccggcaagcggagcccagagtggatcgacgctggcgagctggagaggggggattacatggcccaggtcatcccatctgaggtggtccctgtcgcgggcttcgacgaggacgatgctcgcctctacgggatcctcctgggcgatgggcatctcagcaagaatggcctgcagtggggcgtctcggggcacccacagagggacgggcacatggatttcgttagggcgtacctgtccgctcggggcatccacttctgggagaccgcgagggacgagacgtacgggcagattcattgggctagcggcaggggggtccgcagggatgctaccacgggcaggatcacaggcgctggggctgcgactctccctttcgagcacgccgacctgtacgatgagcagggccggaagcgcatcgctaggcgcttctcacatctcccaaggcagcagtccctcgctctgatcaggtcgctcctggagtctgacggcggggtgtctcgcggcaaggagatctacttcacaaacacttcaaggcccctcattgagggcctgaggtaccagctcctgaggctgggcgtgccaaccgctgggcagtacagggagaggaggcaggaccacgtcggccagagggctgatgggtcgccaatcaggttcgagggcgtgtgcaaggcgtacgacctcaggattccggctgttccagaggtggctcagctggtcggctgccagccaatcgccaagcggaattggattacgtggcagggctgcgtctactccaggatccgggatgttcagccgattgcggtgaagcccttcgtcttcgatctcaaggtggagggggatgagagctacatgactacttccgggctcgctcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3164 - DNA, 5294 bp, Artificial Sequence
  Synthetic Construct, AT-7 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcgggggatactgaggtcgttctcgggaatggcatggacgtggttctgctgacggatctcgtggacggggcgtgcgtttcgacaatcgagccaaggactggcgtggtcagcccatcgctcatcgaccattacttcgccaaggatgcgacccgcgtcctcaagatcacgctggacgatggcagggttattaaggctgacccagagcaccctctgttcgctgctaaggtggatgagaccacgcgcggcctcaccgggcagtggctgagggtggaggagctcacggtcggccaccatgctctcctggtgtcgccacagcaggcttactgcacctctgagcagtggacactcactctgtcagagaaggaggtctgcaccgcttccacggctcagctcgctaagcagctgtccgagatcggcctggtcggggttccgattcccctctctaaggtgaagtcagctgccaggctgttcggcctcgtcctgtccgctggcgacttcagcgggaagctctacgtggagaaggacgaggatgttacagccgtgaacagcgacctcactgcgctgggcttctcgccagctcactgggtccggtaccaggacgatcagcagaagtggttcaagtgcgacgattcgaacggcaaggcgatctgcattaccctggtccctacggctaatgctctcctgcagaccctcggggctcacgacgctgagaagcagcatcggtactgcctcctgccaaagtggctcctggatgcccctacgtccatcaagagggagttcctcggcgctctgttcggcgggaacggggcccacatcacaatttcgtgcaatgagggcaagtgggagccgactatgtctgcgctcacacagcacactgacgctgatcatctggagagcacagttgtgtacctcaagcaggttgccactctcctgggcatgctgaacatctgctccagcgtgtcgtctgagaagcacattacagccgagaagactgggtacgcggtccacctgcatgttgacaacacggcggagaatctcgttcggttctacgagcaagtgggctaccgctactgcttcaataagacatcccagtcatccgcccccgtgcagtggatcaaggggtctctgttcttcattgagcagcaccgctcaaagtgccagcatgctttcgagctcctgcacaccggcctcgggacgaaggctgctgtctccgccgagatcaacatgccacaccataatcctagccacatgctgaacgttaaggagatcccgaccgctcccgccgacgagtacatcacgtggattgagttcaaggatcgctacgtgcataaggagtccccgcggttcgtgtgggtcaccatccacagcattgaggaggcgcccgctgagaggctctacgacttcaatacggtttcgcagaatcatagcttcttcgccaacagcatcgtctctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3165 - DNA, 5087 bp, Artificial Sequence
  Synthetic Construct, AT-8 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgggcgggatacccctctcctcatggcggacggcactactaagttcgttcaggacattaaggctctggatcagctcatgggcgacgattgcacgccgcgcatcgtccaggagaggtctctcgttcacgagtcaggggctctgtacagggtggtccccaagaacgccaatggccacgacgcgttcgtgtgcaacaaggagcatatcctcgtgatggtcaatgttaagcagccgtgggtcagccagacggttatcgacggcgtggatcagttccatgtctcggaggttgtgtgcatcgggaacattccgacagtgcgctccagcggcaatttcgcttctgctgtcgaggctacgaaggctctgccagcttggacactcctgatctgggagattagcgtgctggagtacctggcggtcgacgctgatctcaggcagcacttcatgatctacaagccagctggcgggattgagtacccaaccacgacaaacctggacatcgtgcagcacttcggcgccgagtcggttcccaacctggagcatgccgtgatgtggtgcatcggcctgtggattctcctgggggacgtcgatacagccggcaacccagttctcatcctgagcggcattgaccacctccatcctctgatcaagactctccactcgcattctcagaagctgtcaatttccttcaccaaccagctcgacgagggggtcgctgatatcagcaagccaaccatcattgccctcggcgacaagttcgggctcctgttcaagtccctgggcatcgagagcgctgagtgcattcctgatgccctcctgaggtcgtctaagctccacagggctgctctcctggctggcctggtggaggggagcaacgctttctcgatcgtcaaggacactccaaagcattgggatatttcctgcaagaacaatatgatcttcgagaatattaagaggctctcatccagcctcggcctgtgcgttgacacggtgacaccagcgactatcacccagcaggtgtccgtcaagacgctgcagatccggatttcgggccctcgcatgcactacgtgtctgagctcatcagcaacgactcgctgaagactacctctgtcgtttcaatcgattcctggctgaacgtcaagtcaaatgcctgcgagttcgagatcgagtccattggctgcggggagtacttcggcttcacagttatggggccaaactcaaggttcctcctcggggatttcacagtcacacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3166 - DNA, 4985 bp, Artificial Sequence
  Synthetic Construct, AT-9 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacgggggagacgctgctgctgacggagaatggctacgagaaggccgctgatctctacaagaagcagaacaatctgaaggttgtgatcgacaacaggacaaaggacttcgctgtggatagcaagggcaccacgatcgtcgacgctattccaatgcagctgacgaagaaggatgccgagatcttcaaggtcaagaccaagcagggctacgagattcgcgcgacggagtggcacaagttctacgttaagagggacggcgagatccagaagctgcagctcaaccagctgaagaccggggataagctcctggtccagtccgctgagggcgcttacgggaagatccatgagcccgacctcgcctacattatgggcatcattgcgggcgatgggaccatcacggagaagaccgccaagatctacctctacgacaacaagaaggtgctggagcagaaggttacggatgcggtgcacaggatcattcacaagcataaggtcgaccgggcttacaagcataatacatcactcctgccaactttcaacatggcgaatcctgagaagcaggacctcctgtacatgaactccacagttctgttcgatatcctcaagaagttcggcatgaataaggagcgcaagactagggtcccggagttcattttccaggccaacaaggagacacaggccgcgtacctgagcggcctcttccagactgacgggtgcgtgaacgcgaatcacaaggctaaggccctgaccatcgagctcacgtccattcattacgagagcctgcaggatgttcagaagctcctgctcaatatgggcgtgtacacaactatctactcgaacaataagcggtctcaggagctgctcccagacgggaagggcgggtcgaagctctacaacgtcaagcccacccacaagatctcaattcaggatcgcaactcccgcgagctgttcatgagcatcgtcgagctcaaggactacgatgtttacaagttcaacctgctcacagagactctccagccgaagtcgcgcaagcccaagcacgacttcacggccgagatcatttctatcgaggaggacggcgtggaggatgtctacgatactactcaggaggattaccactctctcatcttcaatggcatcgttacgggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3167 - DNA, 4940 bp, Artificial Sequence
  Synthetic Construct, AT-10 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccgctgacacactcatcgctactgacagggggctggagaggatcggcaacatcgtgggggagtctaggggcatcaagtctattgacggcaagctccactgggtcgagaacatcttcccgacagggactaagcccgtttaccagctgaggaccaagtctggctaccagctgaagctcaccggggatcatgtggtcttcacggagaataggggcgacgtcaaggcttgcgagctgaggaaggacgatatggtccggctcgttggcgctccattcgggaaggagaccacgggctccacagatatcgcccagctcattgggctcctgactggcgacgggtgcatcacaactgccaacgagattgctgcttcgggcgagcagaggaggaccgcgttcctgacggtttctaaggctgagcaggagattgcggagtgggctaaccagttcatcaatacgctgaggccggagctcggcgagcacaataagtcggggtctgtgaccgagacggccaccacggcgcgggttgctgtgggctccccacgcatcctcaagcagttcgaggcgttcgctgttctggataagggcagcgtgcataagctcttcacagacaaggtgttccagctggctcagtcggagcaggctgctctcctgaggggcctgttcacagctgacgggactgtcgccaactactccgataagtcccagtacatcgctctggacgctacgagcctggagctcctgcagcaggtccagctcctgctcttcaacttcggcatcaagtccaagatctacgagaataggagggtgggcgagctcgtctccctgctcccagacgggaagggcgggatcaaggagtaccctgtgcagcagatgcacagcctcaggatctcgcggtccagccgcattctgttcgagcagcagatcggcttcatggccgagtcgaagaagtacgaggccctggcggagctcaaccgcacagtgtccacttacagggacagcgcgtacgatgctgtcgcctctctgacctactcaggcgaggaggccgttttcgatctcacggagccggagacggatcatttcattgctaatggcattggggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3168 - DNA, 4658 bp, Artificial Sequence
  Synthetic Construct, AT-11 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctccatggggattcgctcatcgtgacagatcatgggctcgttcctatgcgggaggtcgtgaatcatcgccagcggctgcaggtctcagacggcgagaggcagcagacagtgtacgactggaaccggttcgccgattacccaaccgtcacgatgaggaccagggcgggcttcacactgactgggtcccacaatcatcgcatcatgctcgctgacggcacctggaggaggctggacgagctccagatcggggatcgggtgcgcattgctggcgggaccgagctgtgggctacggagccagctctcctgaggtgcaggaggccgctgcccagggtcctcgttaccgctggcgccccggccgcgaccacgtccagcccccacaggcgggggtacaggagggctgctgctgtggtcgttgacgagaagctcgctgctgctatcggcaggcgctgcgttacgcatgctgaccagcaggccctggatgcgattaggaggtcgccaaggcctcaggtggtcgcgttcctccgcgctttctgccagggcgctgggcagtcggtcgcttctggcctgaccctcacgtgcgctgacgctgatctggccacaactgtgcagctcctgctcacaaacctgggcgtcctcgcgcacaggactgacaccacggttcggattgataatggcgacgatctggagagggcttacacaactctcgccacaccgactggctggaccgacgaggttgtggcgctggagcatgggacggctgatgtctacgacatttctgttactgctactcatcgctacgctgctcagggcttcatcaaccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3169 - DNA, 4268 bp, Artificial Sequence
  Synthetic Construct, AT-12 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgacaggggacactctcatctgcctcgctgacgggcgccgcgttcctattcaggatctcgtggggcattcgccggaggttattgcggtcgacgataagggccgcctcgtttgcgctaagtcagaggtcatctggaaggtcggcgagcggtccgttttcgagatcaagctggcttccgggaggagcattaaggctaccgctgagcacaggctcctggcgttcaagggctggaggcatgttaaggacttcaaagtgggggataggctcgctattgctcaccaggtcccagagccagacaggctcctgcagcattgccagtcggacctgttctgggataggatcgtgtcgattgaggagaaggggtctgaggaggtctacgatctcacagttccaaagtacgcttcttggctcgcggatggggttgtttcacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3170 - DNA, 5198 bp, Artificial Sequence
  Synthetic Construct, AT-13 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacatcggaccatacggttctcactacaaggggctggattcctatcgctgacgttactctggatgacaaggtcgctgttctcgacaacaatacgggcgagatgtcctaccagaacccacagaaggtccacaagtacgactacgagggccctatgtacgaggttaagactgccggggtcgatctgttcgttaccccaaaccataggatgtatgtgaataccacgaacaatacaactaaccagaattacaacctcgttgaggcttccagcatcttcggcaagaaggtgcggtacaagaacgacgcgatctggaataagaccgattaccagttcattctcccggagacagccactctgaccgggcacacgaacaagatctcgtctacaccggcgattcagcccgagatgaacgcttggctcacgttcttcggcctgtggatcgcgaacgggcataccacgaagattgccgagaagacagcggagaacaatcagcagaagcagcgctacaaggtcatcctgacgcaggtgaaggaggacgtctgcgatatcattgagcagacactcaacaagctgggcttcaatttcatcaggtccgggaaggactacacgattgagaacaagcagctctggagctacctgaatccgttcgacaacggcgccctcaataagtacctgcccgattgggtctgggagctctcatcccagcagtgcaagatcctcctgaacagcctctgcctgggcaattgcctgttcactaagaacgacgataccctccactacttctccaccagcgagaggttcgctaacgacgtgtcgcgcctcgctctgcatgctggcacaacttctactatccagctggaggccgcgccatcaaacctgtacgataccatcattgggctccctgttgaagtgaataccacgctgtggcgggtcatcattaaccagagctcgttctactcgtactctactgacaagtcttcagccctcaacctgagcaacaatgttgcgtgctacgtgaacgcgcagagcgctctcacactggagcagaactcgcagaagatcaataagaacactctcgtcctgaccaagaacaatgttaagtcacagacgatgcactcccagagggctgagagggtggacacggctctcctgacacagaaggagctcgataattcgctgaaccatgagatcctgattaataagaacccgggcacctctcagctggagtgcgtggtcaatcccgaggtcaacaatacgtccacaaacgataggttcgtgtactacaaggggccggtctactgcctcactgggcctaacaatgttttctacgttcagaggaatggcaaggctgtttggactggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3171 - DNA, 4865 bp, Artificial Sequence
  Synthetic Construct, AT-14 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacgggggacactctcgttttcactgacaaggggctgattgaggctcgcaagctggaggtcggcatgaaggtctggtcgggggacggctggaacgagatcaaggaggtcattaacaatggggtgaagccggtcctgaagctcaagctgaagaccggcctggagatcaaggttacggaggagcacaagatcttcacaggcgaggggtggaaggaggccaaggacctcaaggttggcgataagctctacctgccggtgtcttaccccgagctggacttccccgtcaaggaggagaacgatttctacgagttcctcggctacttcctgggcgacgggtcactctccgttagcaaccacgtgtccctgcatgtcgggaatgacaaggagctcgcgctgtacttcaaggagaaggttgagaagtacgctggcgctgcttacctgatcgagagggacgggcagtacatcattgatgtgcatcgcaaggagttcgccgagaagatcaagaagattttcggcatcgagattaccgactcgaaggagaaggatatcccgtccagcctcctggcggtgaactccgaggctatgaaggctctcctgaggggcctcttctcggctgacgggtctgtctacgatgctaatggctctatcacagttgccctgtcgtctacttcatacccactcctgcggaaggtccagatcctcctgctctcactcggcattccttccacactgactggggagaaggaccaggatgtgaagatcattaagggcaacgagtacgagaccctcccaacgtaccgcctgatcattagcggggagagggcctcgctcttcttcaataagatcggcctgattggggagaagaagaagaagttcctggagctgatggcgggcaagaccacgtactccaccctcaacaatcacctgtaccaggagatcgtgagcattgagcccgctggcgaggaggaggtcttcgatattacagctccaccaaagtacacttggattaccaatggcattctctctctggatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3172 - DNA, 4235 bp, Artificial Sequence
  Synthetic Construct, AT-15 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgtggcgggcactatgatcctgacagtcgcggggctggtcgctattgagaatattaaggcgggggacaaggtcatcgctactaacccggagacattcgaggtggctgagaagaccgtcctggagacctacgtgcgcgagaccacggagctcctgcacctgacgatcaatggcgacgtcattaagacaactttcgagcatctcttctacgccaaggatgtcgggttcgttgaggcgaaggagctgcaggtcggcgacaagctcctggattccaaggggaacgtgctcgtggtcgaggacaagaagatcaagattaccgatgagcccgttaaggtgtacaatttccaggttgatgacttccacacataccacgttgggtgcaatggggttctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3173 - DNA, 4829 bp, Artificial Sequence
  Synthetic Construct, AT-16 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcccagctggctctggacactcctattcctacgcctgacgggtggacaactatgggggagatcaaggcgggggacaaggttatcgatgagaagggcaggccgtgcaatgtggtcgctatctccgagattgacgatacagagcaggcctacaagatcaacttccgggacggcactagcattgtcgccggggagcgccacctctggaaggttcaggtgaccaacaatggcaggagggagaagctcctgaccacgggggagatgtaccagaagcagttcaagaccaagtcgaaggagaatcgcgcgctcttcaggatcccaattgccgacgcgttcatcctccctgagaacaagctgccgattgatccctacctgttcggctactggatcggcaacgggaatgctgtgaagccggagatcacagtcatgcgcgacgatgtcgacgaggttatcaagaacattccctacaagctccataataggtacaagcaggagggcaactcagacatcctggtttacaaggagctcaagtccattctggtgaagaacttcagggagaagcggatcccaattgagtacctcagggcttctgctcagcagcggaagcgcctcctgcagggcctgatcgactcagatgggtgcgtctccacagccaagagccaggcgatctacgttactattctcttcgagctggccaaggacgtgcaggatctcctgtggagcctcggcatcaagaacacactgaagactgctccatcggctcgctacggcatcgagaccggggagatctgctacctcattaagttcacggcgttcaatgacctggaggtgagcggcctcgataggaagctgaagagggggcgggagcgcaacatcaagacccggtcgcacttccattacatcaagtctattgagaagaccggcaagacgaagatgcgctgcatccaggttgattctccaagcaggctctacctcgctggcaagtctatgattccaacacataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3174 - DNA, 4838 bp, Artificial Sequence
  Synthetic Construct, AT-17 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggcgggggacactaagattctcacatcatcgggctaccatcccatcaaggacatggagggcaagcaggttcgggtttggaatggctacgagttctcggagacaatcgttcacaagactggggtgaaccagaagctcattatggtgtctctggacgatggcaccgagctcaggtgcacgccgtaccataagttctacatcgagaccgggtcgcggccagctgacaagtctcgggtcatggaggttcgcgctggcgacctggagaagggggaccgcatcattaggttcgagctgccgacaatcactgtcggcgagaccacgatgagcgacaaggaggcctacacaaagggcttcttctctgcggatgggtgcgtcattaagtcaaagtacggcgaggatgagtacaggatctcggttaagcgggaggacaagattgaggctctgacgaagtatgtggatgtgatcaagtcccacacaaaccggttccgcactcatttctacgtgccagactacgtccagaataagttcgaggtccctatcaactcaatggttaatgagaagatttcctggctcgccggcttcatggacggcgatgggtgcgttatccgctacaaggacattgagaacatgcaggcggtgtccatcaataagagcttcctgcaggatattaggctcatgctgcagaccatcggcattcactccacgatcaacaagttcatgccgaatcgcgtgatgaagatgcccgatggcaggggcgggaccgacatgtacaacggggctgagagctggaggctccagatcgactcggagggcgtccgcaagctcttcgctctggggttcacgccgcgcaggctgaagatgaacggctccaggaagcggcaccataagaccaataagttcacgcgcgtggtcagcgtgacagaccatggcgatgtcgaggacacttactgcttcaatgagccaaagaggcacatgggggtcttcaacggggtcattacggggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3175 - DNA, 5012 bp, Artificial Sequence
  Synthetic Construct, AT-18 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgatggcaagacaaagattctcacaaatcaggggttcatgacgctgcggcaggtttacgagcagggctacgaggggctctcaacgctgtcactcaacaccaagacgcacaagatcgagtggaagccaattctggacaccatgaagcgccagtccgagatgatcgatatttccgttagccagactggcaggatcaccgacaacacgctgcggctcacccctgatcataagatggtcaatctcaggggcgggaagtacacaaagactgagatccaggacctcctgaagcagcaggagatgctgactgtggcccagaccatcccgagcctcggcaacaataagcaccaggaggcggacctggcttacttcctcggcgggatcattacggatggctcgatctacacatccagcactcggggggaggtccagttcatccagaaggacgttccggagaagcaggctttcatttcgaagatgaacgatctggccaattcgctctacggcaagtctttcacggcgcacatcaagcccgtgtcgtcttcatacattaggggccagaaggtcacggggcaggctacagcgtacaggctgcattccaaggctatcgcctacgacgtcaaggagcgcgagaacaatattacacagctcctgctggagaacgaggctgagctgtcttaccatttcctcggcggcgtgatcgacggcgatgggtgctaccacaagaacaggctccatatctacatttcagaggagaatctgctccaggccgtcatcattgcgtgcctgaagatgaatactgtgccgcaggtcaccaagaaccggaatatctaccacctccagattgtggagaagctggaggtcatcctccggtacacccagcgcgtcaagggcgaggttacccccaggacgatccagacacggttcttcgcgacgcgccagctgttcgagaaccaggagacaggccagatcaagctccggcaggacaacaattgcctgatttctgataagcagctccgcgagatgggcgagttcgaggagctgatcgacggggatactcgcatgcagagggttattcaagtgggcgagaagagcgacggggatgtttacaacatcaccgtggcggagcatcataactacgtcgttttcacagccaagtacacaccagtcgtcgtttgcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3176 - DNA, 4871 bp, Artificial Sequence
  Synthetic Construct, AT-19 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgccggagacaaagatcctcacagacagggggcagatcgccatcgctgacgtcgcgggggagaaggtcaatatttggaacgggtcggagtggtctgaggttctcgtgaagaagacaggcgagaaccagccgctcctgaaggtgcacttctcaaatggcgagtccctggactgcacttactaccacaagttccatgtccaggagaactacaaggggaaggtcaagatcgttgaggctaaggacctccaggagggcgataagctgattaagtaccggctcccactggtggagtccgagaatgacatcgatttcccttacgcctacaccagcggcttcttctcgggcgacgggtctcatgatggcatggggaagccggagattgacctctacggcgagaagaaggagctcctgcccttcgtcacggttaggaacaagtactacggcgggtcatacggcgacaagtcctggcgcatcgagagggatgaggtggccgtctacgacgatgttaaccaggaccggatcgtgtgcaagctcccgctggatattcccgcgaagttcacagttcccgtgaatggctacactatccagagcaggctggagtggctggctggcctcctggacgcggatgggacagtcgctaggaacggcgacaatgagagcctgcaggttgcgtcgacccaccagcagttcctcctggacatccgcctcatgctgcagacgctcggcgtcgactctaaggtggtcaagatggatgagatggggtacaggtcgctgccagacggcaagggcgggtaccaggattacttctgccaggcgaagtaccgcctcctgatttccagcaacggcctcttccagctgggcgagctcgggctgaagaccaacaggctccagtggaatctgagggagcctcagagggaggcttcccagttcatcagggtggagaaggtcgagctcacctgccggtacgacgatacgtactgcttctcagagccaaagaggcatctcggcatgttcaatggcatcctcacagggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3177 - DNA, 5651 bp, Artificial Sequence
  Synthetic Construct, AT-20 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcttcggacactctcgttcgcacatcggagggggacaagccagtcgctgaggtcgctatcggggactacctgctggacgctgaggacaagccagtcctctgcatgggcgctaacccttcccagaccgggcgcatgaaggagatcgcttaccaggacttcgattcgaagaagagggtgtctttcaagtgcacaccggaccaccacctggagctgacactcactgattccactccctccctcagcggcaagtcagtcacctggttctccaggtgcacgggggctcacctcagcgaggaggtgtcggaggtctacctggacaacatggtttcgatcttctacaatgatctggttgactcgacggattctgcggtggacaaggattccattcacgaggccgtggacctggcgctggaggatcactaccataggggcaactctgaccagtactcaatccatctcaatgagtacatcagccggattgccgataaggagctgcagaacgagccggagttcatccgggagtgcattcacgacgccgcgaatcgcttcgtcatcacctccagcggcaacaggaatattaagtcggagtctttcgacgataagctcctgctctcacgctccaggtcgtctacagctgacagcgattcggactacgtgatcactgacgcctccgtccactctcattcaaacaattcatccgtctacctcgcctcaccagactccatgatccctgatggcgctgccaaccgcttcgagaatattgcgtccaagctgaaggagccagtgtgcaactgcggcgggatccggaagattttccgcagcttcggcaccacggaggacgctgagctcgcttactccctgctcctgagcgagcactactacaggctggacccacggttcgtcacagatggctacactttccaggcctcggttgagcagtacgagaacatgtgctctcaggaggtgcagaatatgcacctgaagctctaccgctcacctctcaagttcgtggagagggagcataactccgctgagctgccagtcgacccatacttcctgggcctctggctgggcgatggggacagctcggggacaactatcatgaccacggatcgggagattgtggtctggctcaactcctacgtcgagcgcctgaaccagaataagccggagggctgcttccccctcaagctgaccgagcagctgatctacggcgctgggcacacgtccaagagcgggcatacaactaaggtcgacgttaggaattacaagatctcttcaggcgatgctttcgtgcggtcggggacatactggaacccgattttcgacggcctcaagaagctggggctcctgaacaataagagcgctggcatcccccaggagtacatgaactctgacgagcagaataggctctcagttattgccggcctgatggattccgacgggtgctacgtgaagagccacaacacctaccgcttcacccagctcacggaggaccataagaagatcgtctacgatctgaaggagctcgccctgagctgcggcattaacaccacgggggtcgagctctcggttaagccgctgggcttcaataagcacaagcattctaccgagtatgtggtgtacctcggcaacgggagccagaagttccaggagctcctgctcctgccacggaagaagatggagatcagcaagaagcacgtgtcgctggacgcgcgccctttcacggttagcgacgtggaggatggcgagttccgggctattgaggtttcagggggggttttccagctcgctaataggctcgtggttgctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3178 - DNA, 4712 bp, Artificial Sequence
  Synthetic Construct, AT-21 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccagccatacgacgctctcgtttcaacgccatcggggctcgttcctatcggggctctcgtggagacagacgcggtcggcatgaaggtgttcgatgcgcacggcctcacacaggtcattgctactaagagcaacggggttaaggacgtgctgaggatctggacccgcgcgggccacgctctcgacgtcacggccgatcatctggtttggaggtccacaagcgctggcgctggggctttcgtgccagctggcgctctcagggctggggacacactggagtggcataggactattgctccaggcgagggggagatcacgagccgcgagattgctgaggctgctctcgctggcaggctgcaggctgatggcttcgtcgggcgctacgctgggaccaatgcttcgctcacgatcgaggcgatgaccgttccaacgaggctctacgacgctccactgccagtggtcgctgcctacctcaggtcactgttccaggctgatggctacgtctcgcgcagggagaggtctaccctcatcggcctggacatgatttccgaggggctgatcaggggcgttcaggggctcctggctaggttcggcatcttcgccagggtgcggagggaggctgatccacgccctgacaggcacgatctctggtccctgggcattcagaacgctggggacaggcggaccttcgccgatgagatcggcttcctcgacccagtgaaggcggctaagctggaggcttccttcgaccagccaggccaggctgctaagcctgtcaagaggctccagatcgagaggattgagccgaggggcccgatgcccgtctacgacattcagacagattccggggagtacctctctgctgggctcagggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3179 - DNA, 5168 bp, Artificial Sequence
  Synthetic Construct, AT-22 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggtcgcgggcactgaggtcacagacgctgagacaggggcggtcgttacggtcggggagctcttcgagtcgcggagggcggtcacagtccacgctctcggcgctgacagcaagctgaggccaaggcctgttactgatgtggtctggaacgggcgcaagagggtgtaccgcctcaccacggagctgggcaagtcgatcacagccactgacaaccatcctttccgcgtgctggatggctggaagaatctcggggagctgaagccaggcgacaggatcgctgctccaaggaggctggcggtcccttcggctggcacctggccgcagcacgagattgttgcgctcgctgggctcctgtctgagggcaacacgtgccatcccacaactctctacttctacgggaatgaccgggttctgatcgacgatttcgcgcgggcaattggccagttccccgatacagtcgccaaggtttacgctaggccaaacaggaggaacctggaggtgcgcgctaacacaggcagggacactcgcctgaagtcaagggcggagagggatgctgctgtggctctcctggctccaccaacgaggtccggcgctttcgtctgggctcagaggctcggcatcctggggaagaccgctacggagaagttcgtgcctcacgacgtcttccggctctgcgacagcgatctggagctcttcctgggcaggctgtgggctggcgacgggttcattgctaatgataccctcaaggtcccgttctacgctacgtccagcaggaggctcgctcaggacgtgcagcacctcctgctcaggctgggcatcgtcgggaggattcatgagaagcagttcaagtacaagggcgggctcaagcccggcttcacagtgcacctgatcggcgacggggctgctgaggccttcctcgataggattgctccacactgcctggggagggagcatgctgtcactatcctcagggagcatgttgctaccacggcgaggggcctcacctccaaggacacggttccgctggaggtgcgcgcttgggtcgacgatgggaggagggcgaggggcctcacctgggacgagctggagcagcagtcggatgtctctacacaggagttctacggcactccagctccaggcaagaaggggttccggagggctacgatcgctaagctcgctgcgttcttcggctcacagaggctggctgctgttgctgactccgatgtgttctgggacagggttgtgagcattgagtacgcgggcgtgcaggatacctacgatctcacagtggatgaggatcataatttcgttgctaatgggctcatcgttcacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3180 - DNA, 4691 bp, Artificial Sequence
  Synthetic Construct, AT-23 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccagcctgcggggacacaggtcgctaaggttattaaggaggggaggtggagggaggattcggttattgagcaggttcctattgagtcactccagccaggcgacagggtggtctccttcgggaacgcgaagatctaccgcaggggccgcgctgtgacagggattacttcccggcgccacacaggcaatctgcatagggtcgaggttggggagttccgcaccagggccacgccagagcacaggttcaccgtccggttcgacccagctaggcctaaggctggcctcctgtacctcatgaggaggggcgataggtggagggtgggcgtctgcgggatgttcaactcgcgcggcttcggggtttccgtgcggctgagccaggagaggggcgacgctgcttgggtgctcggggccttcgcgacactgactgaggctaggatcgccgagcaggttgtgagctgccggtacggcattccaaccacggtctgggagaccggcaggaatcctggggcttcgtgggctcagagggaccaggctggcatcgatgccatctaccagaggctcggcgtcgataggatccgggctggggttgacaggctcctgagggatcacggcctctctgctgggctgccactcctggctgccaacgagcccggcaatttctcgtgcaggcagtctaggcaggtggctgcttgcaacctggtgccaggcgtcatgcaggtcccagttccaacggctggcgagaggttcgagtggagggacctcaccgctacgagcttcgagagggttcatgatctggaggtgtggagcatggatgtggagagggataagcattacgttgcggatggcatcgttgtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3181 - DNA, 5066 bp, Artificial Sequence
  Synthetic Construct, AT-24 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctgcggggacgctgctgcatactgagcagggctacgttccggtggagcaggtcgtggcgggggtcgggacaagggtttgcacacaccagggcttccggaacatctctgagcgcttcgataatggggaggccgaggttttcagggtgaccacgcggaagggctactccgtggaggtcactgcgaaccacaagatggctcgcctcgacgagaatggcgatctcctgctcgacgagctctcacatctgcaagtgggcgacaacctgctcctgctcctggggtccaatccggtgaccgagaaggtccggctgcagtgcatcccagctggctaccgctccagcatcgagattgctcagccgcccgagctcgatgagcagctggcttacctcctgggctacgcctacggcgacgggtgcgtcggcaggggggctacatacaactacctcagcctggctgtgtcgcacacttacccgaatgtccgcgaccagctcgccgcgatcattagggagaagttcggcctgacaactaagatctactcaggctccggggcggtttggaacctcctggtgcattccgccaatctcctggattggctcaaggcgaacggcctcctgaagcagaaggctgcggacctcgccatgccagaggcgattctgcgctcgccttcgtctgtggtcggcgctttcctgtctgggtacttcgacgctgatggctgcgtgaggggcgggaagggcgggtacgggttcgattgcacgagcaaggctttcgtcggcgctgttcagctcctgctcctggccgaggggatcgtgtccaacctccacaccacggaccggagccgccagggctggcgcacaatctacaggctcaatgtctgcggcaccgagttcaagcgcaggttccagacgctgtgctgcaggtctgcgaaggttgtgcattcaccaatggtgctcggcagggatgggaccggcgggtacccacctgctctggttaggggcgcttcgtaccagagggtcgttgctgtcggcgggaagcacctcctgtacacggcgctcctgaaggtcatcgagaagacaaggactgctggcaagcaggctctcgctgagagcctgtgccagcatgtcaactacttcccggaccccatcgtcgcgattgagtcggttggcacgcagagggtttacgatattgaggtggagggcatgcatctgctcggcaatggcatctacacaagcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3182 - DNA, 5306 bp, Artificial Sequence
  Synthetic Construct, AT-25 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcctacgacgcggagatcgttcaggctgacgggggggttaagactattgagcagatcgttagggagcggcgggcgcatctcgctacggtcggcgctgactggaggctgacatggactgagccgtgcgattacgttgacgatggccacaagcccgtcttcgaggttaccacgcgcctcgggcgcaggatcgagacaactctgacacacccgttcctcactgtccatggctggcagaggctggaggacctcgctgagggcgatgctatcggggtcccaaggcagctgccagttttcggccaggagcccattagggactgcgaggtgaggctcctgggccacctgatcggggatggcgggctcaccggctcgccacccaggctgacgtctgggcaggaggcgatgacagctgacttcctggaggctgtggatgctttcggcggggtcgaggctaagccaatcagggcgtcccggaggacgcagagctgggtggtcgttggcgctgctcaggcccgcgctgctgctaggtccagcttcgcttcactggtcgacgccctcattaggaggtcccctctcaccggcagggctatcgctaggaacctgggggtggcgccagctaccctcacgtactggaggcagggcgtgaatgtccctgacgctgctatggttgggctcctggctggcgagctgggggttgatgtgggcgagctcaggccagagcctgtggctcgcaggaacgaccgcaatccactgcaggcttggctcgataggctgggcctcgctgggaagtccgctcacgagaagactgtgccagactgcgtcttccggctgcctcgcgagcagctcgctaggttcctgaaccggctcttctcgtctgacgggtgggtgacacatctggctagcggccaggggcagattggctacaccacggtctcggaggctctcgctaggcagatccagcacctcctgctccggttcggcgttctggctaagctcaggcataggtccgtgcgctaccaggacggcaggaggccagcctggcagctggatattactcacgcggagagcatcctcaccttcgctgagcagatcggcattctggggaaggagcagcggctcgcctctgttgctgcttcagtgcgcggcaggaggaggcagtcgcacacggaccatatcccctgcgagatttggcagttcatcgatagggccaggggcgagtggacatgggctgagctggctaggagggctggggtcgcttcatccaatatccacgcctacaggaggggcatgtctaggcagaggctggctgctttcgctgacgctctcggctcaagggagctgaggcagctcgcgagctcggacctgtactgggatcggatcgcctccattcgcccgctcggccataagcaggtgtacgatctcactattccagagactcataacttcattgctaatgatgtttgcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3183 - DNA, 5261 bp, Artificial Sequence
  Synthetic Construct, AT-26 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgcatggggatacaagggttactctcgctgatgggcatgagcggcctattcgggaggtcgtggagtcaaatctggatgatccgaagccagtcgacgatggggtttgggataccgtggacttcgatgtcccttctctgcagtcagacggcacagttgcgactcagaacgctacgaaagtgtggaagcggaaggcgccggagacactctaccgcatcaggaccgctacgggcagggagctggatgtcacaccatcacaccctctcttcgttcagtccgacgggaggttccaggctaggaaggctgaggagctggagtctggcacccatgttgctgtgcccaggaaggtttcaactaacgcctgcaatgagctcgacgtcaccttccggcagtctcaggcccacaaccgcatcgacctcgatctgccaccacagtggacgccagagctcgctaggctgatcgggtacattgttgcggagggctacgtggagcagaggcctgataatacgggctacgtgtccatcacaaacaatgaccgggaggtgctggacgatgccaagagcgtcctggagactctcaacctgaatgtcaccgagcgctccagccacgaggggaagacggcgagggagctcctgtgcagcgctggcgagttcgtgtccttcctcgccagcctggacgagacactcctgcagtcgtctgctgagaggagggtcccgcaggatattatgagggcttccgacaacgtggtcaccgggttcattcggggctacatcgagggggagggccatgtgtcaacgtcccagcgcgagatcacagtcgcgagcatgtcgaagccgctcctggaggacgtcaggaccctcctggttacgcagggcattacagcccagctgcagccccggaacaatgggtcctacaggctcaggatctccggccagagcttccacgactacgcggagcagatcggcttcattactgcccgcaagaccgaggcttgcaggcagttcgaggggacgcatggcaacacaaatctggacattgtgccgaacctgggcccagagctcaggcgcatccgcgaggctctcgggctgactcagagcgagtgcggcctcccaaggtcgacctaccagcactacgagaggggcaggaggaatccctcgcgggattctctggagtcagtgctcgacgctttcgagactaggctggccgagatgaacaatgacactccaatttcggataccgctaggtctgacggcgggggcacgggctcgctcaggcaggatctcaacgggctggctgctctcgtggagggcgacatcgcctgggatcgcatcgagtccattgagcctatcgagcatgacgagaagtgggtctacgatctggagattgagggcacacataactacctcacaaatggggtcgtctctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3184 - DNA, 5444 bp, Artificial Sequence
  Synthetic Construct, AT-27 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgactgcggattcggacgttctcgttaggtcggagaatggggatattgagcgccagacggtggactctctcttctcggacgggcaggtggtcctcgcggacggcgataccgacatcgctgtttctaaggagacaccgactgtgctctcactggacgaggcgactgagagggtgagcgagcaggagtcgaccctcgtctctgagaggccactgagggacgatgagagcgtccgcaccatcgagacgtcgaggggcgctgtcaccgttacggacgatcacccaatgtacatcaggcaggacggcgaagtgactgtccggcctgcttccgacattgaggctgggaccgatctcgtggctgctaggaggccaccagacacgatggtcgagccatcagatgagacggttctgtcctgggagacattcgctgccgattgcgacaagcattctaagctctacggcgtcgactgcgggacagagctggctgctcagagggctgcgcgcgatgagtcccagactgctttcgctgagcgctacggctcgtacgggtctgctgtgggcaagtacgagaggggggagaaggacgttccggtgtggctcctgggcgagctcgacatcaggccagatcggattcacgggctgaactacgagacgtcgttcgagaatccattccctctggagtggtccccagagctggctcaggtcatcggctgcctcctgggcgacgggagcattcaccggaacgacgatgagaatgttgtggacgtgcgctaccataacacagatgaggctctcatcgagcgcttcgccagggacatcgagcgcctgttcgatattgagccaacagtcactgacaggcctggcagggagagccaccataagaggaagtaccaggtcgatgttccatcggctgtcggcagggtgctcgtctgcgttctggaggccgtgacggagaacggcacaccagggctcccagacgcggtccggcctgctttcgttggcgccctgttcgacgatgagggccacatctcccgcgaggggaaggcgttcattagcaatacagaccatactctcctgaccggcgtcggggagatgctcgctgagatgggcatcgagaccaagctcgcgccagaccagcacaagctgcatattaggggcaggaggaacctggagcagttcctggaccggatccctattgcgagcgatgagaagttctaccgcggcctcgatgctctggacgcctacgatgtgaccacgaggaaggctgagctcctggaggcgatcaggcaggagccaaagacctcggctgctctcgctcagactctgggcgtgaccagggggtccgtcaataagtacctcagggagctgcgggagtccggccacatcgagaagcagattgaggggtcaaaccggtccctcgacgagaatcgcacggttcagtatgtggcggctgatttcgagggctccgtgtacgctacgctgaggggggagccgtccagcgtgacagtcgaggacgttgagaggcgggagtacgacggccccgtgtacgatctgacggtttcagagaatgctccaaacttcgctgtcaatgggggggctgtggttcataactctacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3185 - DNA, 4376 bp, Artificial Sequence
  Synthetic Construct, AT-28 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgcggggggacactacggtcgctctcgctgacgggtcggagcgggagattcgggatctcgtggaggctaatctggatgaccctcggccagttgacgatggggtgtgggacggcgtggatgtcgctgttccttccctcgctgctgacggcaggctggttcagcgcagggcgacaaaagtgtggaagcgggaggctccggagacaatgtaccgggtccgcactgctgctggccacaggctcaccgtcacgccatcgcatcctctgttcgtggctgggtctcacggcccagacgccgtcaggacggaggacctggaggttgggcagctggtgggcgtcgccccggacggcgatgggtcgggccaggtcgctccagacggcggggttatcagggatgctcagccagctccagtgggcgacgctgagaccgtcgcctggtccgcgatcgagagcattacggaggtcgagccggatgaggagtgggtgtacgatctggaggtggagggcactcattcatacctcacggatggggtcgtttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3186 - DNA, 5141 bp, Artificial Sequence
  Synthetic Construct, AT-29 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcagttacgggggacaggccagtggtcgttagggatccggggggcacagttcgcattctcccaattgaggatctcttcgctagggggaccacggagtcagaggtcctcatcgctgctgacggcgatgtggtcgcttccgctacaccaggcaagactaggagggctctcgacgggtgggatgctctgtccgtgaacgaggacggcgaggctgagtggcagccaatcgcgcaggctattcggcacaacaccgacaagcctgttgtgaatctccagcataagttcggcgagtcaacaactacccgcgaccactcctacgtcgttccaggcgaggatgggctgacgacagtttccccagacgatgtggctgagccttaccgcgtcagcggcgttccagacgtggagcccgtcgagcaggtggatgtctacgaggttctcaggggctacgagagggagtacgaggacggcaggtcggtggggtctgataactcaatcacaaagaggaagcagattcacgcggacgatgagtatgtgtggttcggccatgagcaccatagggacgttgattcgaccgttaaggtgaagcggttcgtggacatcgattctgaggacggcgctgctctgattaggctcctgggggcctacgtcccagagggctccgccagcaccggggagactgcgaccagcaagttcggcgcttcgctcgctgagtctgacagggagtggctcgctcagctgcagagggattacagccggctgttcgagaatactaccgctggcatcattacatcggacaggagggctgagaggactgtggagtaccagacggacacaggcggggcttcggtcacctacaacgatgagacgctcaagctgcagatgatgaatgagctcgcggctgtgttcttcagggagttcgctggccagacgagcagggggaagcggatcccgtcgttcgtcttccacctgcccgaggagaagcaggacctcttcctgaccctcctggtggagggcgatgggagccgcgagttcccaaggtacacggaggcctacgcgcagcggaacttcgacttcgagacgacatctcgcgagctcgctgctggcctgtcaatgctcctgacgcagagggggcagaagcattctctcaagtaccgggactccaaggatagctacactatccgcacctgctccacgtacagggagggcagggacccagtcctgaccgaggctgaccacgatggctacgtgtacgacctctcagtggaggagaatgagaacttcgtggatggggttgggggcatcgtgctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3187 - DNA, 4475 bp, Artificial Sequence
  Synthetic Construct, AT-30 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcgggggatacggagatcgctctcgcttcgggggattctattactttcgagtcgctggtggacgcttacgagcggggggagacacactactgctacactatcggcgacgatgggcggatccgcattgaggagattatgaacccgcgggtgacccaggaggacgctgctctcctggccgttacgctcgataatggcgaggtcatcaggtgcacacccgaccatgagttcatgctccgggatggcaactactgcgaggcgcagaatctgaccgacgggcagagcctcatgccactgtacaggaccacgacagagatgactgagactaccgagacgacagagactaccgggacagctgagatggtgaagcagccgttcgcccagaacaattgggagtccgtcagccagctcgctaaccgctacaatcgcaggcacacgacaactgaccatatcgttgagacgcagcagattcagtcacagcagcagtcccagatcgagaccgtccagatttctgagagggcggacgttcacaaccataccgtgatctcggtcgagtctctgaccgagacggctgatgtctacgatctggaggttccagttactcataatttcgctctcgcttccggggttttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3188 - DNA, 4457 bp, Artificial Sequence
  Synthetic Construct, AT-31 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3189 - DNA, 5546 bp, Artificial Sequence
  Synthetic Construct, AT-32 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcataccatcctaggtcggaggtcctgctcgctgacgggcagcggattgacatcggcactttcgtggattcgcgcattgagaagaataacgccaatgttatcgacggcattaactgcgagatcctgccggtggacgatattgatgtttacaccgtggacacagatactgggtccgctagcacggtttccattgacagggtgagccggcacccagctccatccgagttcatccgcgtgaagttcagcaacggcaggtcggttctcgtgaccccggagcatcccatgttcatcgacgatgggtcagagaccaagacggtccaggctaatgctctgagcggcggggagttcgttccagctcctcaccatctcccaggcgtgaacaccgacgcgtccagcgtctccgacgatatcaatgatgttagcaccattaggacgcacgtgaggtcccgggcgcgcgctaaggctgaggtcgaggttcgcgctacggacggcgagttcaagctcatcgatgccgcgcagaccctgggcatcattacggctgtggggaaggtgagcgtcgacgctccagagcggggcatcattgtcgacatggatcgcacagttgactcgtctaaggattcgatcaacaatgtcctggggtctgttattccttcaaacgacaatgattctatcactagggtccaggacacaggctcgactgggaaccagtggaggtggtctgtgaataccttcatcgagcggatgatcgagattgctccagctgtcacggctgacaggccaaacaggagggtgcctgatgctgtcctcggcgggagcgaggctgtggtccagcagttcctgacaggcgtgatcattgctgccgggcggatcctcgacgagactatccgcatctacgcttcatccaacgagctcgcctgcgactacgccgatgcgttcctcaggctgggcatcaccgcttccgtcgaggacgggccagctgagatcgcggctcagaccgtgatcaagtgcgacagcgattacgagcgcgcgtgcggcatgttcgacatcagctcgtctaggaccacgccctccgatacatcatcccagaacaatcagagctcggtcaccgcccagaacgaggacacgcaccagacaactagccatgagatcctcccgtcgggcattgcggatgagctgcagagcatcaggcagctcctgaacattcccgcctcggagcagctggcgtctatcacggctggcgacgatgggatcgcgctctcgattgctagggccgagatcaacctcctgcgggaccacattgagacactgcgcatggatactgagaatgtcagcattggccgcgacgattgcgttacaccgactatctcttcatccagcaagtacaagtacgcgaagaactcaatcacctccgacgagaatctccagctgttcggccagtcacaggcccagctgtccgagaggacaaagaccacggagtcgtcttcaatctcggcgtctactgacctcgtgtctatcccagctaacatttcagagaataggctcgtggctgctacacagaggctggacgaggtcgagactcgctgcaaccggcgctaccacagggtcatcgccgttgacacggtgtccaatgccggccctcatgcgtgcgagtgggtctacgatattactgtggagcctaccaacactttcatttcttccggggtcgttctgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3190 - DNA, 4904 bp, Artificial Sequence
  Synthetic Construct, AT-33 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcactcctgatacaaatgttctgacgcctaatggggttcgcaatattcgggatctcacggtcggggattcggtttactcgctgaacccggagaccatgcagatggagatcaagccggtgacacagactcacgagtaccccgactaccagggcgacctcatcgatattcagacaaacgagatcgatttccgcgtcactccaaatcataggatgctggttgaggctaccggcacggacaccacgtccaccaacgactacgatttcatcgaggccgggaatctcgatatttccagccggtacgagctgcctcacggctggtccgttgaccatacggatagcctcggggcctacatcgacctgattaccctcctgagggagcagtcagacacgtacaacgtcctctccgatggcgggatgacaactgctgctacggctgacatcaatcacaacaatgtcacccgcagggttgactctgatacgttcgtgtcactgattggctggtatgtggctacagggcgggtctcgcgcactcagaacggctctgacagggtctacctccagctgtcccagacaaatactaaggcgcggacccagctcacgatgctcctggacgagctgggcgtggactggcaggctgataacgagaagatccacttcgtgtctcatgtctggacggagctcttcgacaccacgtgcggccgcacagagaagaacaagcacatcccggagctgattttcgacgcttcagcctcccagaagagggcgttcttcgatgctatcattaacggcagcggggtcaagaatgacgattcgtaccagtaccacacctcgtctgaggacctcagggacgatatcctccggctgtgcgttcatatcggcattgtggcgcggtacgactacatcaacgatgagtcctggcgcattgagtgcaccgagacggccaatcccgacttcacactgactcatagcggcaggcagtcgacagctgaggatggggtttactgcgtgactgtggcggataatcagactctgctcgccgggaggaatggcaccttccagtggacaggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3191 - DNA, 5417 bp, Artificial Sequence
  Synthetic Construct, AT-34 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccatcctgagactaagatttggttcagggacacagacaatgagtggcatcatgagactattcagactttcgtggaggaccgcctggacgatccagagatcgatgcggttggcacgctcgtgcaggaggtcgacgataacacagaccgggagatctctgtgccttcaattgacgataatggcaacgagcgcctgcagtcagttactgctgtgtccaagcacagggccccaaatcatctcgtgcagatcgagaccattagcggcagggagatcacaattactcctgaccacgagatgcatatcttcgagcagggcaacctggtgtcgaagcaggcttctaagatcacgtcaggggagtacgccgtcatcccgaagcgcctccagacgatttccccatccagccacacacctcagcatgatctcctgagggagttcctcacgcgggatgagctgacagccgacaggctcatcattcacacgtctgacccagtccggctctgcaaccgcgttttccctgaggaggtgacatcatgcaaggatgcggttgagatcatgcagaatactgcttgccatctggacaagaacaaggagaccctcatcggctggctgggcgaggggcgcattccggtcgctctcctgagggggttcgttgagacggacgaggcgctcctgatgagcatccccgacgatgttcagattggcctgaggggggagaaggtgcgcatcgacaggcacattggcttcacggaggagctcacatcgctcctgggctactacgctgctgctgggatcgtgcatacccagacgaatcccatttcctacgagagcgcgcagcaggagcagtcgaggatcaccttctacaacattgatacacagactcagaccgacctcctgaatgccctgaactctgtcttcgagatcgagccgattcagtacaacctggacggcgagatcctcggcgtgccaggggagctcattaggagggtcttcgatactgtcttcgacgttgggacccagccatcccacaagcggatcccccaggctctgttcgatgcctcagagtcccacatcacgagctacctgcgctgcttcttctccactcatgacagcctcaccacggataccagggacatcagcgctacaactgtgtcgcgggagttcaaggaggacatcattgctgctctcaggaggctgggcatcacagctgaggtcaccacgcagcagagcaggtcggtgccagaggtcctcccagactggtacgcgatcgacgatattacgcaccatgacgctgataattccctcaacctgacacggtcctacgtgatctctattgcgtcgtctgatgctgttaccctgcagagggacaggcaggctcaggagcagatcaagtacgacgcgcagggcctcatcgccaacaataacgcgattcaccagagcaggcaagtgactgatggcgggaggaaggactacatcactgagccgatcaccgacattgagtatgtggacgcggatatcgactacacctactgcctcactgtttcggagactcactcactcatcgttaatgatctctctcagaagcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3192 - DNA, 5462 bp, Artificial Sequence
  Synthetic Construct, AT-35 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtcgctgcggactcgcggctggtcgctgtttcgccggatgacaagatcgttttcactactattgaggatttctggaagaagctgaacacgccaatcgagcgcaatgggaagttccggaagcgcacatgcgtctctgagggctggcagacttacgctttcgacgagaaccacgaggcctcactgaggcctatcgagaaggcgattcggtacaccgctgatgagtctgagcagctcaggaggatcaccacgcagctcggcaggtcgctggacattacggatgagcactctctgttccgctacgacgatggcatcgaggaggtggctggggacgatctgaccgctggcgacatcattgtcgcgccgaggaccctcgatgttgaggtgacgcagacaactctcgacctgtccgagtacatccacgataacgagaggtgcccaagcgagcagaccggctcgggggagctcaatctggcctccaagagcgcgatctcggactctaggaacaaggagaccccgggcgtgacgcataatatcctcccccagcggagcaagttcaccgacgagatgaccacgctctcaccaacggctgttggcgggctggagtccgagcagaacgagaccctcagggtcggcgagagcacgggggccatcgagaggtacattaatgtggacgattcgttcggctggctcctggggcagttcatcgcgcagaggtcaatttccacagacgctctgaccatgacggtccacactgccgcggagaagcatgccgagcggatcgttgcgaccagcgactcggtgttcgggattaagccaacggtgaactccatcgagcgcggctacgagattgtgttcccttccgtcttcgacacaatcgtcagcggcctcactgcgaaggagcagagcgagcccgagcaggacgtggatcacacacatactgacgagatcggcattccggagtgcatcctgcacgcccccgacgatattgtcctctccttcctgcaggggttcatcctcgcggagaacgctcagcggaagggcaatgctgcctccgaggccagcgagatggtctctgagtcagagacaactgttaccctggagacgccatcggtcggcgttaaggacgggctcgtgttcctgtgccacaggctcggggtcatcacggatatttcggagaagtctggcgaggagtacagcgttcatttcgaggagtctcgctacacagtgtcaatcgccacagagggcaagactaaccccctcgaccagatcctgaatggggagaggccaacaatgcctgagggcgtgagcgtcccagttccagatgctctcctgactatccacgagtcaattgccaactccccacatatcgaccaggtcattcctgataccgtggtccagcaggagacagtttccctggagactctgcagagcctcctgaccggcctgtcgacggtggacctcccagctcagctggaggctaagcgcgacgagctcacactcctgactgagggcgatctctcttacctgagggtggagtcagtcgagtgcgttgactacgatggctacctgtacgatctccaggttgggggggagccagttttcacagctaattggctctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3193 - DNA, 5054 bp, Artificial Sequence
  Synthetic Construct, AT-36 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcactgcggactcaacagtcatgctcaaggagaaggggatggtctcggtctcggaggtggagacaggggatcagatcgctcagcgctccgacacaggcttccagtacaagccggtggaggagactcacgcgtacgagaacgctgagacactcactgtcaccctgacgaacggctgctctatccgcgggaccccgaatcacaggctcatggtcgacgatgagtggacgcgcatcgacgagattcagcccgatcaggaggttcattacacactcggctggctgagggagactaaccagtccccgcccaagctccactctcagtcacataccacggtgaatcagacagctgactccatcagcccggattccagcgagcccattgagctgtcggagtctgagaacgcggacacgggcaacaggcacaattctgctgttgccgtgaagcagtcacggacacagactcagctgatcagcgacgaggtggtctcgcggccagagcacaccaggaggcctgatcagctctccgaggagctggctgagctcctgggcctctggatcgacacggggctgtggcatcagagcggcgtccagttcaacgttgagcgcgagaatatcgcggagtacattgaccagctctcacagcagctgttcgataccccagctgctatctccgacacggatggcacctacacggtggacattacagatcataagctcaaggagtggtggaaggctaacttcggcgggaagccagacggcactcagtcgtcttacgtcccacagatgatcaaggaggcccctacaaatgttattgaggcgttcctgagggggtgcttcactgctgagggcgggctcaggaaggacatgaggccacggctgtgcacctcatccgaggatagcatcgacgatattgcggtcctcatgatgggcctggggtaccctgtggagaagtcggtcatcaggaacgctgacggcgagccgtactactcggttatgcccgctaccgacgatgggctctctgccttcctgcacgacgtgggcttcatcgatgagcggcgcgagatcgggctctccaacattgagagctcggatagccgggccctgaacaatacccataagatcgaggttgagtcaattgtggagtccccacctgcgacggtctacgacattacagtggcggataatcatgagtacgttacagatggcatcatttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3194 - DNA, 5144 bp, Artificial Sequence
  Synthetic Construct, AT-37 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggaggagaatagcctggtttctaccgatgaggggctgcggcctatcaaggatctggacaatactactgcggagttcgagcagtgggacgagatcgatgtcggcgttaccacggacggcgggaccaagacggctacagctgtttacgataacggcttcgccaatgtgcgccagatccagaccgagagcgggttcaacattgctgctaccccaaatcaccggttccgcacgctgtccagcgacggcacttacacctggaaggaggctggcaagttcgagtccggggaccgcgtgatcctgcagaggaacaccttcgatgctggctcccgcgtgtccctggaggctaatgagagggctgacgatgcccaggacacaactgagggcccagagctgccagggaggatgacgtccgagctggccgagttcctcggctacttcatgggcagcgggtacatctcggacgagacccatgcttccgtggatctggtggtcgacagcgatgccacggagctcaactcatacctgtccaatctcggcgagcagctcttcaggattaccccggccgtcgagtctcaggagatgtcacaggttctgtccttccgggactgccacctcagccgctacttcgaggataacggctggaagaagacggacacaggccataatggggatgcttcggctgctttcgtcccagagcagatcctggagggcgacgagcaggttgtgaacggcttcctcaggggggtgttcgaggcgattgggacggtctcggagaagatcgagattctgaccacgtctacaactctggctgaccagctccagagcctcctgctctcgctgggccacgtgttcacccgggatagcacgaagctcgtcgagacaaacaattaccatgacgatcagctgaggcagaggctctgcggcgctactaggagggaggacgagcggttcatgaacgagatcgggtcactcattgagccagatgagctgaacctctccacacgcgcggacaagaatgatacttacccttcgtctgttatcgaccacgtgcagacactggacggctacgattcagtgtccgagagcctcaagtctcgcattaaccagtcacaggtcgacgggacggttagcaggaagctgatcaaggatattgaggcggagactgctgagaccgtctcgatcgccgaccatgagctcacaggcttctacgcggctactgtggagtctgtcacggaggacacagcgtacactaaggatatttcagttccaagcaacaacacatacatcgccgacgggttcgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3195 - DNA, 4472 bp, Artificial Sequence
  Synthetic Construct, AT-38 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctattgaggctgatgagtcaatcgttattaggcgggacggggagactgagctgacggagatcgggtcgttcgtggacactattctggccgcggacaaccaggagacccggatcacggatggccacgagattgcgctcgctccgaatgggctggaggttccctccctcgacaccgatgagcagatcaggtggaagcacattgaggcggtgagccggcatgcttcgccagacgagatcctcctgattgagctggagtcaggcaggtccatcagggctaccaaggctcactccttcgtcacgaggagggacggcgatgttctcccagtggctggcgagacactggtggtcggggacgtcctccctactgttggcagctacgatcatgcgtcggggtctatctcagtgccgctgcagtcccagagcgtcgctgctgacggcgggaccgttgagcccaacacaaatatcactgccaacgcggagcgcgattcggcctctattacctctgcgggcatcattgggtcggctacgtgggagaggatctccagcattgagacagtggcgccggagtacgagtatgtgtacgatctctctgtttccgggctggagactttcactacgggggagggggtcgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3196 - DNA, 5114 bp, Artificial Sequence
  Synthetic Construct, AT-39 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcactgcggggacaagggttctgcgggctgatacgggggcggagactactatgggggagctgttcgcgctgcaggctagggacgttccggtgtggtcactcgacgagtccctgcgctacgtccgcaggcacctcactagggttttcccaaccggggtgaagccagtcttccggctgaggactgctagcggcaagactgtccgcgctaccgctaaccatccattcctcacctacgatgggtggaagcctctcggcgagctgtcggtggctgacaggctggcggttccgaggcacgtgccagctccagagagggtggcttcatggacggacgatcaggtcctcctgctcggccatctcatcggcgatgggtccttcgtcaagaggcagccactccgctacgctagcgttgacgaggctaacctgtcggctgtgacggaggctgctgctaatgccttctccattgtcgcggttcgggacgagtacgctgctgctaggtgcaccacgctcaggctgccagctccttacaggctgacccacggcaggaggaatccactcgctgcttggctggacgagctcggcctgttcgggctcaggagctacgagaagttcgtcccgcaggaggttttccacctgcccaagaggcagatcgctctcttcctgcggcatctctgggcgactgatggctctgtgacgctgacaaggcagtcacgcggcgggaggatctactacgcctcgacatctctccagctgattcaggacgtctccaggctgctcctgcggttcggcattagcacgagggtgcggacaactaccccaaagggggaccacaggcctggctacacactcgatgtttctggcgtggacgatcagaggcggttcctgcaggagatcggcgtccatggggccaggggcgctaccgctgacaggctcctggaggtcatcagggatgtctccgcgaacacgaatgtcgacacagttcccaggcaggtttgggacgatgtgcgcaggctcctggtggagaaggagatgacgcacagggagttcgctgctgctatggggacatcgttcggcgggtccagcctctggaagcatgctccatctcgcgagaggctcggcagggtggcccaggtcctggactcggccgagctcgatgttctggcggtgaacgacgtcctgtgggatgaggtggtcgcgatcgagcctgacggcgaggagcaggtctacgatgctactgttctcggggggcacaacttcgtggcggatggcattgctgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3197 - DNA, 4970 bp, Artificial Sequence
  Synthetic Construct, AT-40 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacggctgacacatgggttatgacggcctcgggggctaggcaggttcgggatctcattgacaggccattcgaggcggtcgtggacggcgagtgccacccaacagagtcccgcggcttcttcttcactggggataagcctgtgctcaggctgtcgacggctgagggccacacactcaggctgactgcgaaccatccggttctcagggtgtccaagatgaccaggcagctgcgggagacggagtgggttaaggctggcgagctcaggccacacgacaagatcgtcctccacgatcatagggctctgccatcctgggacggcgctcataccgaggctgagggctacctgatcgggctcctgattggcgggggcaccctcacgagggacaaggctatcctgtctatttgggatgctgctgctccaaaggtggctaacgggggcggctcagtcccagctgctggcgtcgccggggttatgagggctgctgagctcgctgctcggaccctgccacaccgcacggacttcaatggctggcagaccacgatggagggcaggggggagtaccacatggctacaggcgccctccatactctcgctctggagctcggcctgacaccaggggataagcgcctcactgcgcctctggagacaacttccagcgctttccacaggggcctcctgagggggatgttcgacgccgatggctcggttcaggggtctcagaggaagggcgtgtccatcaggctcccacagaccgacctcgggaacctgcagacggtccagaggatgctcctgaggctgggcgttgctagcaccattcatcagaataggaggccaggcgggaccaaggtcctcccagatggcgagggcggggctaaggggcactcatgccaggccgcgcatgagctgatcatttccggcgagaatgtggtcaggtacgctgagcggatcggcttcgccgactcggataagatggacaggctcaccgctctcctgcagaggtacaggcacacgaggcatgctgagaggttcatcgcgacagtgcagagcctggaggacgatggcatggaggccgtctacgatgttacagtggcggacgttcatgctttcgatgctaatgggctctacgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3198 - DNA, 4325 bp, Artificial Sequence
  Synthetic Construct, AT-41 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgcgggggacactgagattactgtttcggacgggcggcgctggatgtcgctccctattaggcagttcgttactgagaatttcgacatctcaaagccgggcctcgatcacgttgggacattctactccgacccaaggcagccattctacgtccgctcgattgattctcagggcaagacaagcctcaagcgggtgacttccgtcagcgttcacagggctccagctcatctggtccggttcgctaccaggagggggagggtcctcaccgttacgcctgaccatgcgatgctggtgtgggacacggattacctccgcaagatcaaggctctggaggtggctgtcggcgacagggttccagtggaggagggcgggctcgtggtcgctgatgaggttgtgtctagggagacggtgcaggctctggacgatcgggtctactgcctcactgtggcggagaatcatactctcgttgctaatggcatcttctgcgggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3199 - DNA, 4640 bp, Artificial Sequence
  Synthetic Construct, AT-42 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctgcgggcactctcatcaagacaccaaaggggcctgttcctattgagcagattcagtcgggggatctcgttttcaatgcgatcggcattggggtggtcgagggcatcgtgtgccagcagaagcagaccattacgctggagctgtctgacggcacatcaatcgtctgcactcacgatcatccattcttctgccctcgcggctgggtcgctgctggcgacctggaggttggctccgggctgttcagccacgaggatctccgcaggctgtggtcgggcggggcttctctcggcctggagtccgggtccagcgacggcaggggggctgttcgctcgtctgaggtgctcctgaggatcctcagggaggaggctcgcgagccagatgctggctactgcgggccagccgaggacgtgcgcaacgcgtctaccgatagggctcatgctgagggcgcttggtggcagtggcaggctgacccgattgcgtcagatgaggctgctaggtccgctggcaggagggtcgctgaccgcgttagggacgaggataggagggaggctaggccagagccaaccgctgtcctcctgcaggacaggcactgcgagccactggctaacgatcggaataggagcggcagggagcattcatcccggggcacgggggaggctgagggccagcggcagggggacgtgccatgctcggtccgcgttgtgagcatctcgcgcgaggagaggggcgggcctgaggcggtgtacaacctcagggtttcagggcatccaagctacttcgctgggggggttctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3200 - DNA, 4325 bp, Artificial Sequence
  Synthetic Construct, AT-43 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccatggggacacactcattgagatctacgctgacggcattctggaggagattccgatcaggcggttcgttctggagcatctggatctctcgcaggctggcgtggacgctctggggacgttctacgctgatccggtccggccagctcacgtgcgctccgtcgacacaggcgggatcccacacctccgcaagattacttccgttagcgtgcataaggcccctgcgaacctgatccagttctcgacctctaggggcaagaatctcctggtgacgccggatcatgctatgctcgtttgggacgtgtcctacctccgcaagatcagggccctggaggtcaagattggcgacgctgtcccagtttgggagtcaggggtggtcatctccgacaggatcgtcagcattgattacgttccctgcgaggacgagcgggtgtactgcctcactgtggatagggatcataatgttgtgggcaatggcatcttcactgggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3201 - DNA, 5327 bp, Artificial Sequence
  Synthetic Construct, AT-44 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcaccctgacacatacgttattctccctgacgggcgcatgaagaagatttcggagattgatgaggatgaggttctctcagtcaacttcgaggacctgaagctctacaataagaagatcaagaagttcaagcacaaggctccgaagatcctctacaagattaagaccgcgttctccgagctcatcaccacgggcgagcataagctgttcgtggtcgagaacgggaagatcgtcgagaagtgcgttaaggacctcaatggcagcgagctgatcggggttgtgaggaagctgaactactcgttcaacgacaatgtcgagttcaaggatgtctacgttgagcgccactacaagctcgacgagacaatcaggaacaagctgcgcaaggtgagggagaagctgggcctcactcggaaggatgtggagaagctctgcggggtcaaggagatctacattgttaagatcgagacaggcaagctggagtcaattgaggaggagcggctgaagaagctctgctccctgtacgggatcaacttcgaggagatcatctaccgcgacaacctccactacactaatccagtcaagttccctaagacaccgactcccgagctgatgcagatcattggctacatcattggcgacgggcatttcccctcgaatcggatgctgcgcctcaaggatgagcgcaaggaggtcctggaggagtacaaccagctgttcaagacggtgttcaacctggagggcaatatcaagaagggcgacgggaactactacatcctggagatcaacagcaagtacctgatcgattggttcagggagaacattccggagctcttcaacaagacaggcaatgagaggactcccgagttcgtgttccggctcaacaatgacctggtcgcttcttacctgcggggcatcttcgatgccgaggggtacattcgcgccgaggcgaagcagatcggcattgggatgacatcaaagtgcttcatcaaggagattcagttcctcctgctcaggttcggcatcctcgcctcctacagcaagattaagcggaaggaggagaactggaacaatacccataagctgctcatctcggacaagaagtctttcgagctgttcaagaagtacatcggcttcacggcgaaggataagatggagaagctggaggctatcctgaacaagatgaagggcctcaatttccgctacatctccattccactgaccaagaaggagatcagggagttcgtgggcgtccctctgaagacgattaagaacggggacaattactgcaccgattacacgatcgagaagatcattgaggagctcaactccaagggcctgtacgacaaggccgagtacctcaagcgcttcctggacgcggatatcgtttggacgaagttcaagattgaggaggtggagagcgatgttgagtatgtgtacgatctggaggtggaggactaccacaacttcattggcaatctcatcatcaaccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3202 - DNA, 5333 bp, Artificial Sequence
  Synthetic Construct, AT-45 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcaacgctaacactgagattctgcaggagtcggggttccgcaagattacggagctgaataaggatgagaaggttttcgcgctgtgcggcaaggagatcaagccagtcgacgggtggaaggttcacaagacgcctcagcatgagtacaacatcgtggtcaagacagtcaatggcctggagattaccacgacaccaaaccacatcttcctcgttaaggagaatggctcgctgaaggagaaggaggccaaggacctgaaggttggggattacgttgcgacggtggaccggattcgcgtgaaggagaaggacatcgatctctctaacggcgacctgtacttcattgggtacttcatcggcgatgggtacacaggcgtgatcgagaagaacacgctcaaggctacaccggatctggccttcaaccccaagtacccgcccaatttcgacgattcggagctccacaagaagtacttcctgaagtgccggatttcaaagggcgtcgctcattacatctactccaagaagctccgcaagattttcaacaagctcaatatgctgaccaaggacaacaagaatatcgatgcgttctgcaacctcccgctggacaagctcgcctacctgatcgcgggcctcttcgactccgatgggtacatctacctgaaccggaagaatattgagttctactcgatctctgagaagctcgtggagcagctgcagttcgtcctcctgcggttcggcattcactccagcatccgcaagaagaagaccaagaccatggtgtccccaactaacgggaaggagtacaagtgcaaggacatctacgtcctcaccatccgcgatttcatgagcattaagaggttctacgagaacatccctctccgccatgaggagaagcgcaggaagctggaggagatcattaagaataaggagatcggccagattccgtctgagttcgttgcgctgaggttcacccccatcgctaagatttggtgcgactgcggcttctcagtggatctcactatgttcaagccgcgcaccaagaggcagcgggagctgaacaagaagagggtgaagctcctgttcgagctcctggacggcaagaagctcatcacgaactacaaggagtactacagcaagaggaagaatccctacttcgatttcattgtccgggagaagatcaacggcaacaattactacagcctcaatgagaaggggagggttctgatgtcgctcctgaacaagcacatcaaggacaaggagaatctggaggagatgtacaacttcctcgtgaatctggagaagtgcccaatttgcggcaagcctatccataaggagatgaggtactcctggaagaaggagtgctacgacggggatatctactgggaccggatcaaggagattaagaagatcaaggtcaacgacaagtacgcctacgatatcgagctgccagatgacgggtctaattcacactacatcgttgctaacggcttcatcgtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3203 - DNA, 5006 bp, Artificial Sequence
  Synthetic Construct, AT-46 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttccgcctgacactctgctcatcctggagaatgggttcaagcgcatcgtggacattaaggtcggggacaaggtcctgacgcacgagaaccggttcaagaaggttgagaaggtgtacaagcgcaggtacatcggcgacatcattaagattaaggtgcgctacttcccagaggagatcattctcaccccagagcaccctgtctacgctatcaagacggagaagaggtgcgatggctctcatgggatctgcaagttcaactgcctcacacagtacactaatccttcatgcaagaagcggtaccgcaagtacaagagggagtggatcattgccaaggacctgaaggtcggcgatgtgatcgtctacccgattcccaacagggttcgggacatcaagtacctctccctggataagtacctcagcaatatcaagagggagttctgccgctcccgcatcccggagaagattgaggtctctgaggagttctgccgcctcgttggctacttcctgtccgaggggtactgcttcagggacggcatcgggttcgctctgggcgagaacgagaagaagatcattgacgatatcgagtacctcatgaagaagattttcaatctgaagcccaagatccgcgacgatggccgctcagaggggatcgagctcaagtactactcccgggtgctgcgcgacttcttcggcgatatgttctactgcggggacgagaagcgggcctggaacaaggcgctcccaaatgagttcctctacctgcctaagaacaagcagctgcagatcttcattggctggtggaggggcgataagggggtcaccacgtcggagattctgatgaaccagctcaggctgatcagcctccggctgggcttcatcattaccttctcgaagcacgttccgaagaatcccaagatcggcgacagggaggtcatcaagtaccatgctaggtggcagggccgcgtgtccatcctcgacgagaagattgtcgatgagctcaagaacgaggacatcaagctgccgaagaaggatgttcgctacggctggatcaaggggaattacctgtacgctcccatcattaggatcggccgggagtactacgacgggttcgtctacaatctggaggtggaggatgactcttcatacgttacagtctcaggcactctgcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3204 - DNA, 5468 bp, Artificial Sequence
  Synthetic Construct, AT-47 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgatgccgcatgagaaggtgctgacggagtacggggagattaagattgaggacctgttcaagatcgggaaggagatcgtggagaaggacgagctcaaggagatcaggaagctgaatattaaggtgcacactctcaacgagaatggcgagatcaagatcattaacgccccatacgtgtggaagctcaagcataaggggaagatgatcaaggtcaagctgaagaactggcactcgatcaccacgacaccggagcatcccttcctgaccaacaatggctggatcaaggcggagaatattaagaaggggatgtatgtggctatccctcgcaagatctacggcaacgaggacttcgagaagttcatcgagttcattaattccaagatcctcacgaacgagctgattgtgaaggtcaatgagaaggacctcaagaacgttgagctgccgtcaacaaagatctacaagaagcagaagaacgtgttccgctccgaggatatcattgagcacaacctcaatatcgagaagatttcgttctctccacggatccaccgctgcggcaagccacagcattacatcaagctccctaagtctctgaacgagtggaaggccatcttctacttcgctggcgtgatgttcggcgacgggtgcgtcgatcggatcgcgaacaatgacgaggaggtcttcaacaagctgaagtcactcaacaatctgggcatcgaggttgagaggattaagcggaagtccagctacgagatcattttcaagaacgggaagaatgctctcatcaacctcctgaagattctgttcgattacccgtctgagaagaagtcacataacatcaagattccgcagatcctctacattgctcccaaggagctggtggccgagttcatcaagggctacttcgacgccgatggctacgtgaatctccgccagaacaggatcgaggttatttcagcgtccaaggagttcatcgagggcctgtccattctcctgctccgcttcgagatcacttccaagatctacgagattaagaagagctacaaggagaccaagaagaagtactaccagctcaacatcgtcggcaagaggaacctgaagaatttcaagaacatcgggttctccattaagtacaaggaggagaacctgaataagatcattgagaagagcaggaagtcggagaagtaccccatcaacaaggacatgaagcgcctcaggattctgttcggcatgacgcggaatgaggttaacgtgagctactacgccaagtacgagaacgggaaggagatcccatcgtacgagattgtgaagaagttcctcaattctctgaagcctaagaacctcgataagaagatcaaggttctggagggcaaggagcgcgacgtgaattacctcaaggctttcgagagcgatggcctgatcgagaacgggaggctcaccaagctgggcagggaggccctcaatatctggaagaaccacgagttcgggaaggagaatatcgactacatgaagtcgctgatcgagaacattgcgttcgtcgaggttgaggatgtcgagatcattgactacgatggctacgtttacgatctcacaacagagactcataacttcattgctaatggcatcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3205 - DNA, 4334 bp, Artificial Sequence
  Synthetic Construct, AT-48 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctctcgcctacgatgagcctatctacctctcggatggcaacattatcaatatcggggagttcgtggataagttcttcaagaagtacaagaacagcatcaagaaggaggacaatggcttcgggtggatcgatattggcaacgagaatatctacattaagtccttcaacaagctcagcctgatcattgaggacaagcggatcctccgcgtctggcgcaagaagtactcggggaagctgatcaagattaccacgaagaaccgcagggagatcacactcactcacgatcatccggtttacatctctaagaccggcgaggtgctggagattaatgccgagatggtgaaggtcggggactacatctacattcccaagaacaataccatcaacctcgatgaggttattaaggtggagacggtcgactacaatggccacatctacgatctgactgtggaggataatcatacttacattgctggcaagaatgagggcttcgctgtttccaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3206 - DNA, 5066 bp, Artificial Sequence
  Synthetic Construct, AT-49 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcattgagggggacgctaagattctgacggatcgggggttcctgaagatgaaggaggtttacaagctcgtgaagaatggggagaagctcaaggtcctcggcctgaatgctgagacactgaagactgagtggaaggagatcattgacgctcagaagagggaggctaggcgctacgagatcggcgtgtaccgcaagaataagaacaccaaggacacgatcaagattacaccggatcacaagttccccgtgttcgtcaacggcgagctcagcaaggtgcagctgtgcgacatcattgataacaatctctcagtcctgtccatcgactacattccaatgatcgaggagaagtacgagtccctcgctgaggtcatgtacctcggcggggctgtcctgagcgatggccatatcgttcggaggaacgggaagccaattcgggtccgcttcacacagaaggacactgaggagaagaaggatttcatcgagaaggttaagggcgacgtgaagctcatcggcgggaatttcatcgagatttcgaaccgcaacaatgtcatcgagtaccagacctctaggaagattccgtcagagatcctgggcttcattgaggttaatattaacacaatccccctctacgccactaaggacgagatcgccgatctgattgcgggcttcgttgacggcgatgggtgcctctccgggaagaggagggtggagatctaccagaactccagccacattaagaagatcgagggcctcatcgtcgggctctacaggctgggcatcattccgaggctgcggtacaagcggtcgtctaccgcgacgatctacttcaacaacaacctggagaccatcctgcagcgcacgcgcaggattaagctcgacaagctgaaggagttcaagaagccagtggaggacaagaagctgatcgatatttcgcagatcctccctgagctgaaggagttcgactacaagggctacctctacaagacctacaaggagaagctgttcatcgggattaacaagctggaggagtacctgtctaagatcgacaaggatggcattgagcgcatcaagcagaagatcaagctcctgaaggagagcgacatctactcgatcaggattaagaaggtcggcgaggattacggggaggtctacaatatcacggttaaggcggagaacgagttcaatcataactacgtggtttggactaagcattacacacctatcgtggttttcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3207 - DNA, 4937 bp, Artificial Sequence
  Synthetic Construct, AT-50 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccatccaaaggggacaaaggtcgtggtcaagggcaagggcatcgtgaatattgaggacgttaaggaggggaattacgttctcggcatcgacggctggcagaaggttaagaaggtctggaagtacgagtacgagggcgagctcattaacgttaatgggctgaagtgcacaccgaaccacaagatccccctccgctacaagattaagcataagaagatcaacaagaacgattacctggtgagggacatctacgcgaagtcgctcctgaccaagttcaagggcgaggggaagctcatcctgtgcaaggacttcgagacgattggcaactacgagaagtacatcaatgacatggatgaggacttcatcctcaagtccgagctgatcggcattctcctggctgaggggcacctcctgaggagggatatcgagtacttcgactccagccggggcaagaagcgcattagccatcagtaccgcgtggagatcacggtcaacgaggatgagaaggacttcatcgagaagattaagtacatcttcaagaagctcttcaactacgagctctacgtgcgccgcaagaagggcaccaaggccattacgctcgggtgcgcgaagaaggatatctacctcaagattgaggagatcctgaagaacaaggagaagtacctcccgaatgccatcctgcgggggttcttcgagggcgacggctacgtgaacacagttaggcgggctgtggtcgttaatcagggcactaacaattacgataagattaagttcatcgccagcctcctggacaggctcggcatcaagtacagcttctacacatactcgtacgaggagagggggaagaagctgaagcgctacgtgatcgagattttctctaagggcgacctcattaagttctcaatcctgatttcgttcatctctcgcaggaagaacaatctcctgaacgagatcattaggcagaagactctgtacaagatcggcgattacgggttctacgacctcgacgatgtgtgcgtctcactggagtcctacaagggcgaggtgtacgatctcactctggagggcaggccttactacttcgccaatggcatcctcactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3208 - DNA, 5258 bp, Artificial Sequence
  Synthetic Construct, AT-51 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccagcattctccctgacgagtacctgactattattgaggaggatggcattaaggtcgtgaagatcggggagtacattgatgatctcatgcgcaagcacaaggacaagatcaagttctcgggcatctctgagattctggagacaaagaacctcaagactttctccttcgataagatcacgaagaagtgcgagattaagaaggtgaaggcgctgatcaggcacccatacttcggcaaggcttacaagatcaagctccggtctggccgcaccattaaggtcacgagggggcattcactgttcaagtacgagaacgggaagatcgtcgaggttaagggcgacgatgtgcggttcggggacctgatcgtggtcccaaagaagctcacctgcgtcgataaggaggttgtgatcaacattcctaagcggctgatcaatgctgacgaggaggagatcaaggatctcgtcattaccaagcacaaggacaaggccttcttcgttaagctcaagaagacgctggaggatatcgagaacaataagctcaaggtcatcttcgacgattgcattctctacctgaaggagctcggcctgatcgactacaacatcattaagaagattaataaggttgacatcaagattctggatgaggagaagttcaaggcctacaagaagtacttcgacaccgtcatcgagcatggcaacttcaagaaggggcgctgcaatattcagtacatcaagattaaggactacatcgcgaacattcccgacaaggagttcgaggattgcgagatcggcgcctactcggggaagattaatgcgctcctgaagctcgacgagaagctggctaagttcctcggcttcttcgtgacacgcgggaggctgaagaagcagaagctcaagggcgagactgtctacgagatctcagtttacaagtccctcccggagtaccagaaggagatcgctgagacattcaaggaggtcttcggcgccgggtccatggttaaggacaaagtgactatggataacaagatcgtgtacctcgtcctgaagtacattttcaagtgcggcgacaaggataagaagcacatccccgaggagctcttcctggcctccgagagcgtgatcaagagcttcctggacggcttcctcaaggccaagaagaacagccataaggggacctcgacgttcatggcgaaggatgagaagtacctcaaccagctgatgatcctcttcaatctggttggcattccgacaaggttcactcccgtgaagaacaagggctacaagctcaccctgaatccgaagtacgggacggtgaaggacctcatgctggatgaggtcaaggagatcgaggcgttcgagtacagcggctacgtctacgatctctctgtggaggataatgagaacttcctcgtcaacaacatctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3209 - DNA, 5474 bp, Artificial Sequence
  Synthetic Construct, AT-52 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacgggggacactaaggtcatcgtgaatggggagattcgggagatcggggaggttattgaggagatttctaacgggaagttcggcgtgacactcactaacaatctcaaggtcctgggcatcgacgaggatgggaagattcgcgagttcgacgtgcagtatgtgtacaaggataagaccaacacgctcatcaagattaagacaaagatgggcagggagctgaaggttaccacgtaccacccgctcctgatcaatcataagaacggcgagattaagtgggagaaggcggagaacctcaaggtcggggacaagctggctacgccccgctacatcctcttcaatgagagcgattacaacgaggagctcgctgagtggctgggctacttcatcggcgacgggcacgccgataaggagtcgaataagatcacattcactaacggggacgagaagctgcggaagcgcttcgccgagctcaccgagaagctgttcaaggatgcgaagatcaaggagcgcattcataaggacaggacgccagatatctacgtcaactccaaggaggcggttgagttcatcgacaagctcggcctgagggggaagaaggctgataaggtgcggatccctaaggagattatgcgctcagacgctctcagggcgttcctgagggcttacttcgactgcgatggcgggatcgagaagcactccattgttctcagcaccgcttcgaaggagatggccgaggacctggtgtacgctctcctgaggttcggcatcattgccaagctgcgggagaaggtcaacaagaacaataacaaggtttactaccatatcgtgatttccaactcctccaacctccgcaccttcctggacaacatcggcttctctcaggagaggaagctcaagaagctcctggagatcattaaggatgagaatccgaacctggacgtgatcacgattgataaggagaagatccggtacattagggaccggctcaaggtcaagctgacacgcgacatcgagaaggataattggtcctacaacaagtgcaggaagatcactcaggagctcctgaaggagatctactaccggctggaggagctgaaggagatcgagaaggccctggaggagaacatcctgattgactgggatgaggtggccgagcgcaggaaggagatcgcggagaagacaggcattcgctccgaccgcatcctggagtacattcgggggaagcgcaagccaagcctcaagaactacatcaagattgccaatactctgggcaagaacatcgagaagatcattgacgcgatgcggatcttcgctaagaagtactcgtcttacgcggagatcggcaagatgctgaatatgtggaactcatccatcaagatctacctggagtctaatacccaggagatcgagaagctggaggagattaggaagacggagctcaagctggtcaaggagatcctcaacgacgagaagctgatcgattctattggctacgtcctcttcctggcgtcaaatgagatctactgggacgagatcgttgagattgagcagctcaacggggagttcaccatctacgatctgcatgttccacgctaccacaacttcattgggggcaacctgcctactattctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3210 - DNA, 5138 bp, Artificial Sequence
  Synthetic Construct, AT-53 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtctctaaggacacacctattctcgtgaagattgatggcaaggttaagcgcactactttcgaggagctggacaagatctacttcgagaccaacgacgagaatgagatgtacaagaaggtggacaacctggaggtgctgacagtcgatgagaatttccgggttcgctggaggaaggtgtcgactatcattaggcacaaggtcgacaagatcctccggattaagttcgagggcgggtacattgagctgacgggcaaccattccatcatgatgctcgatgagaatgggctggtggccaagaaggcgagcgacatcaaggtcggcgattgcttcctctcgttcgtcgcgaacatcgagggcgagaaggaccggctcgatctgaaggagttcgagccaaaggacatcacctcccgcgtcaagatcattaacgacttcgatatcgacgaggatacggcttggatgctcggcctctacgtggctgagggcgctgttgggttcaagggcaagacctcaggccaggttatctacacgctcgggtcccacgagcatgacctcatcaacaagctgaatgacattgtggataagaagggcttcagcaagtacgagaatttcacaggctcggggttcgaccggaagcgcctgtctgcgaagcagatccgcattctcaacactcagctggctaggttcgtggaggagaacttctacgacggcaatgggcgcagggctaggaacaagcggatcccggatatcattttcgagctcaaggagaatctgagggtcgagttcctcaaggggctggctgacggcgattccagcgggaactggcgcgaggtggtcaggatttcgtctaagtctgacaatctcctgatcgatacagtgtggctcgccaggatctcaggcattgagtcatccattttcgagaacgaggcgcggctgatctggaagggcgggatgaagtggaagaagtctaatctcctgccggccgagcccatcattaagatgatcaagaagctggagaacaagattaacggcaattggcggtacatcctccgccaccagctgtacgagggcaagaagcgcgtctccaaggacaagatcaagcagattctggagatggtcaacgttgagaagctgtccgacaaggagaaggaggtttacgatctcctgaagaagctgagcaagaccgagctctacgcgctggttgtgaaggagatcgagatcattgactacaacgatttcgtctacgacgtctctgttccaaacaatgagatgttcttcgctggcaatgttccaattctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3211 - DNA, 5459 bp, Artificial Sequence
  Synthetic Construct, AT-54 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacgggggacgctaagattactctgcctgacgagcgggagatcaagattgaggatttcattaagatgttcgaggagcgcaagctgaagcacgtcctcaacaggaatggggaggacctggtgctcgctggcgtcaagttcaactccaagatcgttaatcacaaggtgtacaggctggtcctggagagcgggagggagatcgaggctaccggcgaccataagttcctgacgagggatggctggaaggaggtgtacgagctcaaggaggacgatgaggttctggtgtacccggctctggagggcgttgggttcgaggtggacgagcgcaggatcattggcctgaacgagttctacgagttcctcacaaattacgagatcaagctggggtacaagccactcggcaaggcgaagtcatacaaggagctgattactcgcgacaaggagaagatcctctctagggtcctggagctctccgataagtactccaagagcgagatccggcgcaagattgaggaggagttcggcatcaagatttctctgaccacgatcaagaacctcattaatgggaagatcgacggcttcgccctgaagtatgtgcgcaagatcaaggagctcggctgggatgagatcacctacgacgatgagaaggctgggatcttcgccaggctcctgggcttcatcattggcgacgggcacctgtcgaagtctaaggagggccggatcctgattacagctactattaacgagctggaggggatcaagaaggatctggagaagctcggcatcaaggcctcgaacatcattgagaaggacattgagcataagctcgatgggagggagatcaagggcaagacctctttcatctacattaacaataaggccttctacctcctgctcaacttctggggggtcgagattggcaataagacgatcaacgggtacaatattccaaagtggatcaagtacggcaacaagttcgttaagagggagttcctgaggggcctcttcggggctgacggcacaaagccttacatcaagaagtacaacatcaatgggattaagctgggcattcgggtggagaacatctccaaggataagactctggagttcttcgaggaggtcaagaagatgctggaggagttcgaggtcgagagctacattaaggtttcgaagatcgacaacaagaatctgaccgagctcatcgtcaaggccaacaataagaactacctgaagtacctctcaaggatctcctacgcgtacgagaaggacaatttcgctaggctggtgggcgagtacctccggatcaaggaggcgtacaaggacatcattctgaaggagatcgccgagaacgcgctcaaggaggccgatggcgagaagagcctgagggagctcgctaggaagtacaacgtcccggttgacttcatcattaatcagctgaaggggaaggatatcggcctcccccgcaacttcatgacgttcgaggagttcctcaaggagaaggtggtcgacggcaagtatgtgtccgagcggatcattaagaaggagtgcatcggctaccgcgatgtgtacgacattacttgccacaaggatccttctttcattgctaacggcttcgtctctcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3212 - DNA, 5312 bp, Artificial Sequence
  Synthetic Construct, AT-55 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacaccggacacatacgtggttctcggggacgggcggattgagactattgaggacatcgtgaatgctaaggagcgcaacgtgctctccctggacctcgataacctcagcatcaagattgacacggcgatcaagttctggaagctgcgctacaacggcaatctgagcaagatcacactctcgaacaattacgagctcaaggctactccggaccactgcctcctggtgctgagggataaccagctcaagtggatccccgccaaggacattaaggagaacgattacatcgcgatgccgttcaattacaaggtcgagcggaagcccatctccctcctgaacctcctgaagtacctggacatcacagatgttctcattgagttcgacgagaactccactatcttcgagaagattgccgagtacatccgcaacaatattaagacctcaacgaagtacaagtacctcaggaaccgcagggtcccgctgaagtacctcatcgagtggaatttcgacctggatgagattgagaaggaggctaagtacatctacaagtccgttgccgggaccaagaagatccccctgttcaagctcgacgagaggttctggtacttcgctggcctggtcctcggcgacgggtcgatccaggattctaagatccggattgcccagaccccactgaaggacgtgaagagcattctcgatgagacgttccctttcctgcacaactggatctcgggcaatcaggtcatcatttctaacccaatcattgccgagatcctggagaagctcggcatgaggaacgggaagctcaatggcatcattttctcactgcctgagtcctacatcaacgccctcattgcggggtacttcgacaccgatggctgcttctcgctcctgtacgacaagaaggcgaagaagcacaacctgcgcatggtcctcacgtcaaagcggcgcgatgttctggagaagatcgggatctacctcaactccatcggcattctgaatacactccataagtctagggaggtgtactcactcatcatttccaacaagagcctggagactttcaaggagaagatcgcgaagtacctgaagattcggaaggaggctttcatcaacggctacaagacatacaagaaggagcatgaggagcgcttcgagtgcgacctcctgccagttaaggaggtgttcaagaagctcaccttcgagaagggccggaaggagatcctgaaggactccaagatccacattgagaactggtacaaggagaagaccaacaatatcccgagggagaagctgaagacggttctccggtacgcgaacaatagcgagcataaggagttcctggagaagatcgtgaacggggacatttcgttcgtgcgcgtcaagaaggtggagaatatcccgtacgatggctacgtctacgatctctctatcaagcataatcagaacttcatctctaatggggtcatttcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3213 - DNA, 5189 bp, Artificial Sequence
  Synthetic Construct, AT-56 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctggggcgggatgagctgattttcattaaggagggggacaagctgaaggtttgcaagatcggggaggctattgatgagttcatggagaagtacaaggataagatcattgttgatggggacacggagatcctgtacctcgacggcattgctgaggtgtacaccatctccgtgaacgtcaagacggggaaggccgagttcaagagggtctacgcgatcagccgccacaagccgaggggcaaggtctacaaggttatcggcaaggacgggacctctatcattgttacggaggatcactcactcttcaactacgacgagaacggcaatctggtttgcgtgaagccgcgccagatgaagcatatcattaggaacttcaacaatccctacgatgtggagtaccggatcggcgactacattgagacaaattaccagaggactgattccaagtacaacagccggcagaatgacattcccgagaagctcaagatcacaaaggagctgtgccagttcctgggcctcttcgtcgcggaggggtcatacatcactaacggcatctccattaccacgaaggacgatgacatcgctaagttcattgagcggttcgtgaaggagcagatcaacgagaatattgccgtcaagcgctacgaggattcggtgcggttcgtcaacaaggggttctaccgcttcctcaaggagcacatcaatggcaaggcgattaacaagaatagcccggagttcatcctgaagggcgacaaggagatgaagctggctttcctcggcgggctgatctcgggcgatggctacgtgtccaaggacggccgcgtgcagatctacacaacttccgagcagctcctggggcagctccatctcctgctcagcgacctgggcatgatctactcgattacaaagatcaaggaggagggcgagaagatcgagattaagcggaacgagatcgtccgcaattacaagctctacgttatcgagattgccaagaactgcaccgaggacctgaagccctacgtgatccccaagtacaagaaggagaggatcaagccagcgaactacgatcagctcccttacgactaccggatcattaaggagcacctgcgcaagatcaccgataagaagccatacaacgactacgcctggaagtccaacaatcgcaagctgaagctcaacacgctggagaagatcgagcagctcaatccacatctgagggaggagattaacaagttcaagctgaatatccctttcgagattaaggagatcaaggagattgactacaacggctacgtctacgatctctcagtggaggataatgagaacttcatcacagctacaggcatcctctgccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3214 - DNA, 5429 bp, Artificial Sequence
  Synthetic Construct, AT-57 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctcccttacgatgagaagatcctcattttcgagaataacgagtacaagctggtcaagatcggggagttcgtggagaagtacctcaaccgctacaaggacagggccatcacctacggcgataacaatatcgaggtgtacattaaggacgagaatatctacgccccatcgttcgacaaggatggcaagatcgtcctgaagcctatcacgcacgcgattcggcatcgcgggaaggagatctacgagattgagctggagtcgggcaagaaggttagggtgaccggggaccactctgtgttcacgatcaacgacaatctggatgtggtcgaggtcaaggctagcgacctcaaggttggcgatttcatcattacaccgaagatcattccctcaatctccaaggacaagatctacctctcggagatcgtcaagaacaaggacaagtactacgttaagatcaaggatcacatcaagttcattgaggagcatgaggagatcctcaaggagtcctacaaggagtacaagactaagtggaaggacctgaagccggttctcaagaagaagaacgcgttccggctcgatctgatcgaggacctggtcgataaggagaagatcgagaagatttcttacggccacgctaactacatcaacaataagattaagctcgacgagaagttcggctacctgatcggggccttcctctcagagggccattggaacgacaagtgcgtggagatttccagcaccaacaaggagttcatcgagaatctggtcgagatcattgaggagattctcggcaaggacgcgtactacatcacagtgaagggggacaagcgcaggtacaaggacctctacgtgatcggcctcaacaagactgtcgctatgatcttcgagtccctcgggctgaacaagctgtcgtctaataaggagatcccgagcattctcctgtcgaatgagacgttcctgaagggcctcatcaaggggtacattgacggcgatgggtcaatctacgtcgacgagtctaagcgggattactcaatccgcctgtacaccacgtccgagacactccgcgacactctctgcctggcgctcaagatcctgggcattaactaccggctctccatcgacaagaagagcaaggttaacgagaattggcgcgattgctacgtgatcaagattaccggcaaggagaacattgagaagctcctggacgtcgagatcaagaacaatggcgggaaggatgttatcccgaagattgccgagaagttcaaggagatcattaaccagtactcccagagggagtggaaggagcggttcggcattgacgtgaacaatctgcatatctgggaggatctcaagaagggctacatgagcaggtaccgggcgaagaaggttctcaacattatgaagaatgtgaaggagatcgaggagaagtacggcaggctcctggacaagatcgggcagctgattgacaacgatctcctgttcgagcgcatcaagagcattagggtgctcgacgagatccccgagtatgtgtacgatatttccgtggagggcacagagaacttcattgggggggagggcttcatttgcctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3215 - DNA, 5186 bp, Artificial Sequence
  Synthetic Construct, AT-58 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggatactacagtgctgctggacggcaagctcatcaagatcaaggatctggaggacaagtggaaggacgtgaaggtcctcacatcggacgatctgaacccgaagctcacttccctgagcaagtactggaagctcaatgctgacgagtacgggaagaagatctacaagattaagaccgagctgggccgggagatcattgcgacggaggatcaccccttctacaccacgaacggccgcaagaggtgcggggagctcaaagtgggcgacgaggtcatcatctacccgaacgatttccccatgttcgaggacgataatagggttattgtggacgaggagaagatcaagaaggtcatcaacaacattggcgggacctacaagaacaagatcattaatgagctgaaggacaggaagctcatcccgctgacgtacaacgatcagaaggctagcattctcgcccggatcgttggccacgtgatgggcgacgggtctctcatcatcaacaacaagaactcccgcgtggtcttccgcggcgacattgaggatctcaagaccatcaaggaggacctcaaggagctgggctacgatggggaggagatcaagctgcatgagggggagaccgagatcacggactacaacggcaagaagcgcatcattaagggcaaggggtacagcttcgaggtgaggaagaagtcgctctgcatcctcctgaaggctctgggctgcgtcggcggggacaagacaaagaagatgtacggcattccaaactggatcaagactgcgcctaagtacatcaagaaggagttcctctcggcttacttcggctctgagctgacaactccgaagatccgcaaccacggcacctcattcaaggagctctccttcaagatcgcgaagattgaggagatcttcgacgaggataggttcattaaggacatcaaggagatgctcaaggagttcggcatcgagctgaaggtcagggttgaggaggggaacctccggaaggatggctacaagacaaaggtctacgtggcctccatctacaaccataaggagttcttcggccggatcgggtacacctacgcgaataagaaggagacgctggcccgctacgcgtacgagtacctcctgacgaaggagaagtacctcaaggaccgcaacatcaagaagctggagaacaatacaaagttcattactttcgataagttcatcaaggagaagtgcctgaagaatggcttcgttaaggagaagattgtcagcatcgaggagaccaaggtcgactacgtttacgatattactactatttcagagactcataacttcattgctaatggcttcctcacgggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3216 - DNA, 5243 bp, Artificial Sequence
  Synthetic Construct, AT-59 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgccatacgaggagaagattattattaaggagggggagttcattaagccagtggagatcgggaagctcgtggatgagatgattgagcgcttcggcttcgagaagatcgggaactctgaggtctgcgacctcccgatcgatatctacgccctctcactggaccaggatgagaaggtgcactggaagcggatcatttcgtgcatccgccacaagcataatggcaagctgatcaagattaagaccaagagcgggagggagattaccgcgacgccgtaccactcgttcgtcatccggaaggataacaagatcattcccgttaagggctccgagctcaagatcggggacaggattccggtggtcaagcatatccccgcgaattgcgttgaggctatcaacatttccgactacgtgagcggcaattacgttgtggataacatcaacaataagattgccccaaagatcaacggcaagtccattcctaacaatatcaagctcgactacgatttcggctacttcatcgggatctacctcgcggagggcagcgtcaccaagtacttcgttagcatctcgaatgtggacgagctcattctgaacaagatccgggccttcgcggacaagctcggcctgaactacggggagtacgataacaataacggcttcgcggagtcgcatgacatccgcatctactcctccaccctcgctgagttcctgtctaatttcggcacctcgtctaacacgaagaagatcgccgagttcgtgttcggggcgaacaaggagttcgtccggggcctcatcagggggtacttcgacggcgatgggaatgtcaacgccgacaggaaggtcattcgggttacatctaactcaaaggagctcatcgacggcatcgctattctcctggcccgcttcaatatcttcagcattaagacaaagactaagaaccagttcgtgctgatcattccccaccgctacgcgaagaagttccatgaggagatcaatttctcggtcgagaagaagaagtccgagctggagaggctggtgtcatccctgaacgacgataagacatacgactcaatcgatatgattccatccatcggcgatgctctcactaagctgggggagaaggtcgactaccctaaggttatcctcaagaagttcgagcggaagcagaagatcggcagggctaccctccagaggcacctgcgcaggatcgaggagctggctgtgaagaagggcgtcaacatcctcgccctgaaggagtactggctcctgaagaaggccgttgagtccgacgtgatctgggatgagattgtcaagatcgaggagattagctgcgacaagaagtatgtgtacgatatttctgtggaggggctggagactttcactactttcgatggggttctcactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3217 - DNA, 5294 bp, Artificial Sequence
  Synthetic Construct, AT-60 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacatcaaattcaaagatcctgacagacgatggctactacattaagctggagaagctcaaggagaagctggacctgcatattaagatctacaacaccgaggagggcgagaagtccagcaatattctgttcgtgtcggagcgctacgcggatgagaagatcattcggatcaagaccgagtcggggagggtcctggagggctctaaggaccacccggtgctgacgctcaacggctacgtgcccatgggcatgctcaaggagggggacgatgtgatcgtctacccatacgagggcgtggagtacgaggagccttccgacgagatcattctcgatgaggacgatttcgcggagtacgacaagcagatcattaagtacctgaaggataggggcctcctgccgctccggatggacaacaagaatatcggcatcattgctaggctcctggggttcgccttcggcgatgggagcatcgtgaaggagaacggcgacagggagaggctctacgtggccttctacgggaagagggagaccctcatcaagattcgggaggacctggagaagctcggcatcaaggccagccgcatctactcccgcaagcgcgaggtcgagatcaggaacgcgtacggcgacgagtacacatccctgtgcgaggataattctatcaagattacttcaaaggccttcgcgctgttcatgcataagctcgggatgcccatcggcaagaagacggagcagatctacaagattccagagtggatcaagaaggcccctaagtgggttaagcggaacttcctggctggcctcttcggggctgacggctctcgcgcggtcttcaagaactacaccccgctgcccatcaatctcacgatgtcgaagtctgaggagctcaaggagaacatcctggagttcctcaatgagattaagctcctgctcgctgagttcgatatcgagtcaatgatctacgagattaagtccctggacggccgcgttagctacaggctcgccatcgtgggcgaggagtcaattaagaacttcctggggcgcatcaattacgagtactccggcgagaagaaggtcatcgggctgctcgcgtacgagtacctccgcaggaaggacatcgctaaggagattcgcaagaagtgcatcaagagggcgaaggagctgtacaagaagggcgttacagtgagcgagatgctcaagatggatgagttcaggaacgagttcatctcgaagcggctgattgagcgcgctgtctacgagaatctcgacgaggacgatgttcggatctccactaagttcccgaagttcgaggagttcatcgagaagtacggcgtcattggcgggttcgttatcgataagattaaggagatcgaggagatttcatacgactccaagctgtacgacgtgggcatcgtttcaaaggagcataacttcattgctaacagcatcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3218 - DNA, 4835 bp, Artificial Sequence
  Synthetic Construct, AT-61 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtggactacaatgagcctattattattaaggagaatggggagattaaggtcgtgaagatcggggagctgattgacaagattattgagaactccgagaatatccgcagggagggcatcctggagattgccaagtgcaaggggatcgaggttattgcgttcaactcgaattacaagttcaagttcatgccagtttcggaggtgtctaggcaccctgtgtctgagatgttcgagatcgtggtcgagggcaacaagaaggtcagggttacacggtcccatagcgtcttcactatccgggacaatgaggttgtgccgatccgcgtggacgagctgaaggtcggggatatcctggttctcgcgaaggagctccccaacatcgaggaggacatcgagattgataagaagttctcaaagatcctgggctacatcattgctgaggggtactacgacgataagaagatcgtgctctcttacgactacaacgagaaggagttcatcaatgagaccattgattacttcaagtcactgaactccgacatcacgatctacagcaaggatctcaatatccagattgaggtgaagaacaagaagatcattaatctcctgaagaagctgcgcgtcaagaacaagaggatcccgagcatcattttcaagtcgccctacgagatcaagaagtctttcatcgacggcattttcaacgggaaggatgctaaggtgttcgtctcaaaggagctcgccgaggacgtgatcttcctcctgctccagattaaggagaacgccacaatcaataagaagtcgatcaacgatattgaggtctacgaggttcggcgcatcaccaacatctacacgaatcggaagctggagaagctcatcaactccgacttcattttcctcaagatcaaggagattaataaggtcgagccgacgagcggctacgcgtacgacctcactgttccaaatgcggagaatttcgttgctggcttcgggggcttcgtgctccacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3219 - DNA, 5192 bp, Artificial Sequence
  Synthetic Construct, AT-62 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccatccggatgaggttctcttcattgatcgggggcgggggctggagtgcattactttcaaggagctgttcgagctggaggacaaggacaacgtgaagatcctctccttcgatggcgagaagctcagcctgaagaagctcaagctggcctccaagcgctactacaatgacgatctcatcaccctgcggttcaacctcggccgcgagatcaagattacgaaggaccacccagtggtcattctggaggatggcgagctcaagatcaagctgacatctgacgtgaaggagggggataaggtcatcctgccctacggcaacttcggggaggagagggagatcgagattgacatcctggaggagctgagcaagacagatctcattgagaaagtgtggatccacaacaaggacctggcgactaatgagttcaacatcattaagccatacctctcgaataagtaccctcatgacgtcaagaggaacggcaccatccgggctaaggacattctcccgatcaaggagattctggataagtacgggtccaagaaccggctgttcacggcgaagtcgaagtctaccacgatcccctacaagattaagatcgacaaggatttcgctcggctcattggctactacctgagcgaggggtggatctcgaaggactacggccgcaacggggttgtgcgcaagaggattggcctctgcttcgggatccacgaggaggagtacattaacgacgttaagaatatcctcaacaagctgggcatcaagtacattgagaagatcaaggatgggtcacattccattctcatctccagcaagatcctggcttacgtcttcgagaatattctgaactgcggcatcaactgctacaataagaacatcccgccccagatgttcaatgccaaggaggagatcaagtgggagttcctcaagggcctgttccgcggggacggcgggatcgtcaggctcaacaataacaagaatctgaacatcgagttcgccaccgtttctaagaagatggcgcactcactcctgattctcctgcagctcctgggcatcgtcgcttcggttaagaagtgctacaataacaagtctacaactatggcctacatcattaggattaacggcctggagcaggtcaagaagatcggcgagctgttcgggaagaagtgggagaattacaaggacattgccgagtcatacaagcggaacatcgagccgctcggctacaagaagtccgataatttcgcgatcctggaggttaaggagatcattaaggagcattactccggctacgtgtactcagtggagacagagaactcactgctcattacaagctacggcatcctcattcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3220 - DNA, 5012 bp, Artificial Sequence
  Synthetic Construct, AT-63 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctattccgggggatgaggtcgtttgggccaaggtggacggggaggccaagctcattcctattgaggatctctacgagctctggaaggagggcagggatgttgaggtggctgctctcacggaggagggggtggtctggtccagcgtcgacagggttgctaggcacaggaggcggacaggcctggtgaagatcattacaaggactgggcgggaggtcatcgttacagaggaccattccgtgttcactgtccgggacggcaagattgtggatgtcccaacctcagagctctccgagggcgattggatcgtcctcccagctaggctgccagctggcgactcagatgagattgacgggatcaagattgacgaggatctcgcgttcctcctgggcctctacgtggctgaggggtccctgaccaaccagaaggacgctgtcaggatccacaataaggatcctgaggtcatcgaggagattgaccgcatcgttagggagaagggctgggaggggcggtactacgagagcgaccattcgtactggatcaagagccggaagctccgccagctgtgcgagaagctcggcactaaggccagggagaagaggctcgggccactcctgtcgctgaagcctgagctcctggctgctgctctgaggggctactacacgggcgacgggtcgttctctgtgaagccgcacggccgctctgccatcattgaggcgaccacggtctcaaagaggctcgctgatgagctcctggtggccctccagattctggacatcgtcgcgcgccgctacgagtgcgacgataccaagggctcgacgcggtaccgcgtgatgattaccaagtctgagtacatccgcacgttcgttgagaaagtgggcttcgcccagtccgagaagaacgagaggatccggaagttcctcgcggagaggaagtggacacgcggcaggtccgatattccgactgagctgatcgggagcccctacacctacgttgaggtggagtacatctctgacagggtggctgctgatggcgggctcatgaaggccgagctggagcatctgtacttcgacaagattaaggagatcgttcccctggatcgcgacgatgagtatgtgtacgacgtcgtggaggttaagctcgggcataatttcgttggggggcagggggttctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3221 - DNA, 5396 bp, Artificial Sequence
  Synthetic Construct, AT-64 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggcgccggagacaaagatctgcctcgctgacgggcggttcgttagggccgatgagctgttcgaggagctgaaggagcgggggcgcctggttaagtgcgacgagagcgaggaggtgtacgagctgagggagccagttggggtgtccagcctcgacaaggatgcggtggagatcgtcgagggcaagattacgcacgtgtggcgcctcaaggccgacaagctggtcgaggttgaggtgaagaacggcaggtcgatccggaccacgccagagcataagttcctggtcctcgatccttctggcgagatcgttgagaagagggccgatgagctggagatcggggactacattgtgtgcacccagaagctcgtccacgagggcatgtcggaggaggagctcaagagggaggtgttccgcaggctgggcagggacttcttcgtccatctcccggaggaggaggccgagagcgttctggagctcgcgaaggagcggggcatcaaggctctctgggagacgctggaggtggacattgaggagaactcgttctactaccagctcaggaaggggcgcatcagggccgatattctcgtcgacctggctgaggagctgggcctcgacctggctgatctgtacgacgccgtcgaggtttcatacaggtccaataccaagtccacgaagccaatcaggctcccagagccagaggacctcttctacctggcgggcctcatgttcggcgatgggtgctggaaccagctgaccaatggctccgaggccatccagggggaggtgaagcgcattgcgagcgacatgggcctggaggtgcgcgtgcgccgctacgaggggaagacagcccggatcgacttcccagagactgtgcctcgcattctggaggctctcttcgattacccaaggcggaagaaggcccaccggatccgcgtcaacgatttcctcacaagggcgcctctggactgcatcgctgagttcattcggggctacttcgacgcggatggcacagttgaggaggggcggagcgctgtttcggtgacttcggtctctcgcgagttcctggaggatctccagctcctgctccagaagttcgacgtggcttcttacctgagggagggcgatggggcttacaccctctacgtgtccggcgctaggtcactggagaggttcccagggttcagggagccagagaaggctgagaagctgaagaagctcatggagaaggcctcgtcttcagagctggagaaggtcccgatctccggcgagattctcagggaggtcaggggggacgttcccacaactcgcatgttcaactgctactcaaattacgagggcgggcaagtgggcctcaccaagtccagcctggagaaggtcatctccacgctggaggctgtcggcgttgagggggaggctctggagaggctcaaggctctggcgcgggacgatgtgtgcttcctggaggtggtccgcgttgaggaggtggagtacgacggctacgtctacgacttcacagtggaggagcatcataacttcgctgcggagggcttcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3222 - DNA, 4745 bp, Artificial Sequence
  Synthetic Construct, AT-65 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggtttcggctgatactcctattctcgttaggcgggggggggaggttctgcgggttactttcgaggatctggactcatggtacttcggcgacaggggcggggagtatgtggacgtgtctgacctggaggtcctgaccgttgaccggaacttccgcgtcacgtgggctcgcgttagcaagctgatccggcaccgcgccaggaagattctcagggtgcatctggaggacggcacaatcgagctcactgggaatcacgccgtcatggttctggatgagggcgggctcagggctgtcaaggcttcggagattgaggagggctcattcctcctgtccttcgtggcggagctggacgagcagccaacagatggcgggaccgtggtcacgtccgtcggctcggggtctcgcgtgagcgacaccacgtacgagctgccagtggaggtccgcgttgagctcctgagggagctcgccgacgatggcgtgatcgaggcgagcgaggacgtgtcggtcgatctcgcttggctggcccggatttctggcgtcgagtcacgcgttaccgacgatggggtggagctcgtctgggagacaaggactggcgacctcctgccagctgatccagtgctcaagctggtcgagcggctggagtcggacctggtcgacgacctggagtcttgggtcttcgatggcagggtgtcaaaggaggcggttcggaaggtgctgtccagcgtggacgctaagaacctcaggggggatgctaggagggcttacaggatgctccggaccctggttcgctccgacgtgcatgcggttaaggtggaggacctggatgtcatggactacgatggctacgtgtacgacgtttctgttccaggcaatgagatgttcttcgccggggaggttccagttctgctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3223 - DNA, 5276 bp, Artificial Sequence
  Synthetic Construct, AT-66 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgccggggacaaagattctcacggagcatggctgctgggttaaggtggaggatctccctaagatgctgaccgatcagaagctgaaggtttacgacgtggatgagggccgcgaggacgattccgagatcaagttcgtcatggagaggggcattgaggaggacgagagggctgtggtcctcgtgaccgagtcaggcctgacgatcgaggggtccgaggatcacccagtcctcacccctgagggctacgttgagctgggggagattgaggagggcgacctcgttgtggtctacccgttcgagggcgtcgagtacgaggagaaggagggcacgatcctcgacgagtccgatttcgaggacgtggatccccaggtcctcaggtacctggaggagagggacctcatcccactgaggtggagcgatccaaaagtggggacgctcgccaggattctgggcttcgcgatgggcgacgggcacctgggcgagcaggctgggcggctcaccctgtctttctacggcgacgagcgcacgctcagggagctgaagcgcgacctggagtcactgggcgtcaaggcgaacctccatgttcgcaagcgccgctacgagatcgagacagctagcggccgctacgagggggaggctacttcggttgagctgcgggtggcgtcgcgctctttcgctctcctgatggagaagctcggcatgccaagggggcggaaggtggagaccccgtacaaggtccccgattggatcaaggaggcgcctctgtgggtgaagaggaacttcctcgctgggctgttcgctgctgacggctcggttgtgaagttcaagcggtacacaccgctccccatcaatctgactcaggccaaggtcgaggagctggaggagaacctgcgggagttcatgaatgacgtggcgaagctcctgcgcgagttcggcattgagaccacgctgtacgaggtcaagagcaagaagaacgtcgtttacaagctggccatcgtgggcgaggagaatattaagcgcttcctcggcaaggtcgggtacgagtacgatccagagaagaaggtggagggcctcgctgcctacgcgtacctcaagctgaaggagcgcgtcaagaaggacaggaaggaggctgctgagacagctgctgaggtgtacgaggagacaggctccatcactaaggcccatgaggctgtcgctgacgtggtcaacaggaggttcgtggagagggttgtgtacgacggcgggatttccagcgtgcgggtcccagaggatttccctaccttcgagcggttcaaggaggagagggttctcgctggcgggttcgtgatcgaggaggtcgttgaggtcaagggcgttgagccggagtacgacaggttctacgatattggggtttgccacggggctcataacttcattgcggatggggtcgtcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3224 - DNA, 5381 bp, Artificial Sequence
  Synthetic Construct, AT-67 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgcgcctgggacaagggttattacggcctcgggggacgtggtggagattgatgagatcgtggagcgggctgcggagacggctgtggacggcgggctgagggagggctctacagaggttactgtgggggtcaccaacgtcaggacgctggctgcttgggacggcgatctcacctctaatgacgtggtcgcggtggagaagatcgaggctccgtcacgggccgttcgcgtgaggaccaggtccggcgctgagctggttgtgagcgaggaccacaagttcctcgtggacacggaggatggcccaaggatggtcgaggctagcgagctcaagtcgggggatgagctgtactcggtgcgggagctccgcgtgtctgagaaggtcccaacatacctggagctcctgctggaggccgaggacaagttctacgtgcatcctactgaggagttcgaggaggctgtcgctgagcgctacggctccctggctgaggcttgcagggagaaggagctcccatacagggccagggaggctaaggagcgcaggtactacgagctgagcgagttcgctaggctcgctacggctgttatcgagtcggtggacgaggccacagagtacattgattacgtcactgcgggcgggcggaagcgcgttaagttctccagcccaaggccaggcaaggaggtcatgtatgtggcgggcctgatcgcttcagacgggtccgttgatacagagaggggcttcgtgatgttctcaaacactgagcgggagctgctctccgcgttcgaggagattgtcacagaggagttcggcgttgacgcctcgaagaccgagaaccagaatggggtcacgatgctgagggtcaattcccgggttctcgcgcgcgtgttcgagaggctggctgacccgaagactgtcctcaagatgccccgcgagctcgtggctgcttacctggctggctacgtcgacggcgatgggcacctgaaggatgggaagatcgtgattaccacggctgacagggagagggctggcgatctccagctgctcctgaagaggctgggggtgccaagcgtcctcagggagagggacggcgcttacgatgtcgttgtgacagggcacgacgctgctgagctcgctgaggagctcccactgaggcatcctaagaaggctgaggctgctgcttccatgtcgtctggcaggcgctcatccaggttcgaccgggtgagcaggaggttcgggaggctcctgagggaggtgcgcaggaagtacggcgtcagggcttccgatctggggagctcgtctaccatctctcagattgagtcaggcgagaggagggctacgaggaggctcgctctggagatcgtcgagaggctggaggaggtcgttggcgacgttgaggaggtgcgggagctcagggagctggctgagggcaactacgtgctggatgaggtggtcgaggtcgagacggttgagtacgagcatgagtacctctacgatgttacagtggttccagatcatactctcgtggttgagaatggcatcattacaagcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3225 - DNA, 4781 bp, Artificial Sequence
  Synthetic Construct, AT-68 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgctcgtggacaaacgctagggcggttacaaggcgggggttcgtgcatgtggatgatctcactactgatgatgaggtcatgtcggtcgacgatcagggcaggacaatctggcagcagattgacgaggtggtccggttcccgttcagcggcacgctctactcgctgggcgggagggagatcaacgctaccattacggccaatcaccgggttgtgggcctcaaccgcgagaagaccaagtgggttgagcatacaccaacttccctgcctggcaacaagatgtgggtgtacaccgctggcgaggggagcaatgaggactacccgctcaccgatacggagatcaggctcgctgtgtggggcctgacagactcgcacaggtctcccgatggccggtggactttctaccagtccggggagaaggcggagcaggtcaggaagctcctggctgacgctggcattgagtacagggagagggctaggaacaggggcatcaccgagattgatgggaaggtcctcaaggcgccgcccaagacgcagtacgagttctcgctcggcaaggttcaggagctggacgatctcctggacagggggaggagcgagctgccaacatggactctctccctgagccagaggcaggctaggctcttcctggaggagtacaggttcaccgacggcacggataccacgtcagctggggactcctacgtcctctacgtttgcaaggatcgcatgagggagcagctccagatgctggctgctgctaacggcctcagggcttccacaactgagtacaggccagggcattggaggctgaacatctctaatagggcgctctcaggcctgtacaagaataccgtggaggaggtcgcttacgagggggaagtgtggtgcctgcgggttccaaatggcaggttcttcattgaggatgggggcaagattcatctcacgggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3226 - DNA, 4823 bp, Artificial Sequence
  Synthetic Construct, AT-69 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctcgcctgctctactcctattctgactacaaatgggtggtcaactatgggggctctccaggacggggatgaggtctacgcgcctgacggccagcctaccaaggtcatcaaggcccaccccattaacctcaataggccatgcttcaaggtccggttccgcgacggccaggaggtggtcacggatgcggagcatctgtggcaggtgaacgaccggaacaatggcgggagggatcgggtcatgaccacgcaggagatcgctgacgctccatggggcgggcgctacaggttccgggtcccagttaccgagcctctccagacgccagaggctgacctgccagtggatccatggctcctgggcgcttggctcggcgacggggatgcctcgatggtctctatctgctccggcagccaggacctcgattacctgatttctagggtcgagggcctcgggctgtcacacagggttaaccgctacggctcacgcgccgcttccgtctacgtgcatggcatgagggctgtgttctcggagctcgggctcctgaagaataagcacatccccgacaggtacctgaccgcttctgtcgctcagaggaggcagctcctggctggcctgatggacagcgatgggacagtttcggatcgccaagtgactattagcatgaagaacgagaggctcatgaggcaggtgctccagctggtccggtccctgggctacagggctggcttcgggagccgcatggctaggctcaatggcagggactgcgggctggtctacgtggtgcgcttccatacaggctggggggagtcgcccttcgacatgccacgcaagagggatggctgggagcaggcgacaaagacttccgttcagaacctccggctgaatgccatcgttgcggtggagcctgtcgagaccgtcccggttcgctgcattactgttgctcatgagtcttcgctctacgttgctggggaggggttcgttcctacacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3227 - DNA, 5138 bp, Artificial Sequence
  Synthetic Construct, AT-70 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaagaatgattcgctgattttcactgatcgggggctggtcactgcggcggagctcgctgtcggggttcctgaggagcatgcggccttcacggaggttggcgtggacacatccactgggagggcgaccacgaacgctgtgtacaatggcgggaggagcccaaccaagagggctaggctcgccctgggctacgagctggaggcgacgccagagcacccaatcagggttctcagggacgatgcgctggcttgggtgcggatggacgagctccatgtcggcgatcgcgttgctctgaggaggggctcggaagtgtgggggcgctccagcctgccagaggcgttcaggtgggtcaagcctaagtacgccgcgaacctcaagctgccaaagggcctcgtgctggacgaggtcgctgctgaggcttgcggcctcctggtctccgaggggaccctcacgaagcgcctggttacagagttcactaacgccgacgcggataatgtgggcttcatctcgcgctgggcggcttctatcggcattgacctctcaaggaacgggagcgattcgattcagtacctcctgtgctccgtggtcctcagggagtggctggcttggctcggcctggactacaccagggccgctgggaagtgcatcccgcgggcggtccgcttcggcgggagggacattatgagggcgttcctcaggggcctgttcgacggggatgcttctgtcgatcccctcaagggcgttatcgagttctgcacagcctcagagaggatggcgcgggaggtccaggttgctctcctgggcctcgggattctggcttctcgccactcaaggactgtggccggctacgagcagctgtactggcgggtgaccgtcaacgacgtggccacgttcgagagggaggtcggcttctcgtctaactggaataggctcaggctgagggaggctgtggcgcgggcagagggcaggtgccggaacccgaatgttgatacagtgcccatcaacgggctcgtcgagaggctgtacaggactgcccagaagcagctctcctggtcatcccaggagggccgcatcttcgggaattacgtgcacggcgagcatgctccaagcagggctgctctggagaggatggtccagcgctgggggtcggagtgcccaaccgagtgcctccctatcgaggccttcctggagctgcctgttgccttcctgtccgtggagagcattgaggacggcgaggcggatgtcgtggatctctcagttccagagacgcatgagttcgttgctaatggggtcgtttgccataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3228 - DNA, 5105 bp, Artificial Sequence
  Synthetic Construct, AT-71 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcccagcctcaacgcggattctcagggcggacactggcgcggagtcaactctcggggagctgctggcctcgggggagcagcctctcgtttggtccctggacgagaggatgaggatggtcgctaggccgatggttaaggtgttcccctcgggcaggaaggaggtgttcaggctgaggctcgcttctgggagggaggtcgaggctaccggcaaccacccgttcctcacggtggacgggtggatcccactggataggctcacagtcggcgacaggctggctactccaaggagcgtgccagagcccgtccacacagagaggatggccgatgcggaggtggtcctcctggctcacatgatcggcgacgggtcgtgcgtccgcaggcagcccgttcgctacgcctccattgacgagcagaatctcgctgcggtgagcgaggctgctgagcatttcggcgtgacggcggtcagggacgattacgctgctgcccgcgtcaccacgctgaggctcccagctccttacaggctgtcacgcggcaagaggaacccaattgcggcttggctcgatgagctgggcctcttcgggctgaggtcccacgagaagttcatcccacggcgcgtcttcgctctccctaatgaccaggttgccctgttcctccgccatctgtgggccacagatggctccgtgaggtgggacagcacttacaggcaggcgcgcgtctactacacatccactagcaggcggctcatcgacgatgtggcgcagctcctgctcaggctgggcgttcacgggcgcattcgcagggtgaccaagccagggtacagggacgcttggcatctcaccatcgacggcgctgataaccagacggtgttcctgagggatgtcggcgttcacggggcccggggcgacgctgctcaggtggctctggctgagctggagccactggtccggaacaccaatgttgacacggtgcctaacgaggtttggaatcaggtgcgccacctgctcgcgacaaagaacattactcatcgcgagttctcggctgccatggggtctaggttctgcggctcaaccatgtggaagaggtcgccctctcgctcaaggctcgcccgcgtcgctgctgttctggacgatgcggatatcgagatgtacgctaccaatgacgtgttctgggataagatcgtcgagattacgtctctcggcgagcaggacgtgtacgatggcactgttccaggcactcataacttcgttgctcagtctatctctgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3229 - DNA, 4769 bp, Artificial Sequence
  Synthetic Construct, AT-72 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccctgcgggcacagtcgtttcggggccatcggcggaggcggctacaaggcgctggttcgagggggagctggtcgttttcactaccgctagcgggaagcagctctcgctgaccggcaaccacccagtgctcacgcgcggcgggtgggtccccgccaacctcctgaatgagggcgacgaggtggtcaggtcgacaaggccacagggcgctactccactcgttgtgcctgaccaccatcaggtgccggcgctgatcgaggatgtctgggggagcttcgctgttaatggcctccacagggtgccagctgctcctgaggacttccatggggatggccagaggggggaggtcgacatcgttggcccagatcggaccctgtggtgcggccacgacgctgctattgctcagcagcgggagcagcagttcttcacccgcaggacggagtccagcggcctcctggtggctgagtccgtcgctcagctcgttgacctgtggcaggctccacactctggctcgtctatcgggcgctcaggcctcccattcgctctgattggcgggcatggcgggggccctgtcgagaggggcctcacggttgctgctgggggctacccaggcctccatgaggccctggcggactaccggcccggcgatgctgtgctgccaccacagggggtcttcgctggctcatccgagatcgggggcgacgattgcgtgattggcaaggtcgactccacacgctgggatgctccagctctccccttcctggtggaggggagggcgggctacgctagcagggggaaggagctcttcgaccggctgactggccaggtcgagctcgatcgcatcgttattctgcggcgcgtgcagtggtccggccacgtcttctcgctcacaagctcagaggggtggcatacgggcaactcgctcatcgtctctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3230 - DNA, 5057 bp, Artificial Sequence
  Synthetic Construct, AT-73 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttccctgcgggcacaccagtggacactatcgatgggccaaagcctattgagtcgctgcgggctggggatcgggttctctcgcatgacggctcgtacgccacggtggagaagctgatcgagaacacaaatgatcagccactcgtctccattagccacttcggccataaggagcctatcaggtgcacgccggagcaccccattctggtgtggacggaccgggatgtcgagacactcatcgacggcgatggggctgacccgttcaacggcttcgtgtggctggctgctcaggacgtccatccatccgatttcattgttgctactgctccactggagacccgcgagaggagggtgttcgacctcatgaatcacgtcggcgaggggacgtacgaggaggttgacggcctgatccggaaggtgaacacagatgcgaggcatcggaataagcagcgccacaggcagggcttcgtcgctgttacccgctacgtggaggagagctacgacctcggcctgatcctcgggtggtacctcgccgagggccatgtctcgaagcgctctggggttgaggatgtgaggccaacgggcgtgcatttcacactgggggctaacgagattgagaggcacgtcgagctcggcatggccttcaagcaggtcttcggcgttgacctggtgctccacactaaccattcagatcactccaccaggatggtttgcaattctaagatcgtggctagcctcctgctctcgctggctggcacggggtactcaacaaagcggctcgcgcacgaggtcatgaccgctgacgaggatttccagaggggcctgctcgtcgggctcttccgcggcgacgggtgcaccacgacaggcgggatggtcctggacctcgttaaccaggagctgatcgatcaggtccagctgctcctgaggaggctcggcattgttagcgtggtccgcacgtacacaaaccaggctggcaatccgactgggcaggtgttcgtcccaggcctgcctgggaccaacgaggagttcatcttcgacgtggataagaacctccagaattacactggcaggaaggggaccaagcggactacctaccaggttgtgcatggccgccacgtctacgggattcgggctgttgagaggactggcgagaccccaaggcaggtctacaatctgcatgtggagggcactcatacttacactattaggggggctgtggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3231 - DNA, 4847 bp, Artificial Sequence
  Synthetic Construct, AT-74 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggacacaagcgttactctcgcctcgggggatgagaagcctattcgggacatcgtggagtcaacactggaggatccgacagagatcagcgacggcttctaccaggagtcggacattgatgtgctcaccacggatggcggggctgtcgctccaggcagggctaccaaggtttggaagcggcaggctcccgagaagatgtacaggatccggacagagtccggcagggagctggaggtcactccaagccaccccctgttcgtgcagtcagagggcgggctctccccactggtcgctgacgatctcagcgagaacgacttcgtggctgtcccgagggcgctgccagctgacgatggcgacgatttcgggcagcatgtggacgatctgggctccgtcaccgctcggaagacggctgacgctgaggccgtgcgctccgaggacgccgcgacaactccagatgttatccctaacgtgggcgaccagctccgcaggattcgcacctcgctcaggctgtctcagcacgactgcggcctgccaaggtcgacgtaccagcagtacgagaggggggaccggaatccttcgcgctctaggctccagacagtcctgactgcgttcgagcggcgcatcgagcagctctccagcctgtctgacagggtggacgatggcgactcagatgccattgctgccgcgcgggacgagctcaatccatcacaggcttccctggctagcggcatggatgctaccaggacggctatcggggacgatgagaggacggaggctaggccagacggcggggcggttgctgatgctgagagggctgtggctgacgctctctgcagggcgctggctgtcgccgacgatgttgagaggctcaggtcgctggctgacggcgatatcgggtgggacaggatcgattctattgagccagtcgagcctgaggacgagtgggtttacgatctggaggtggagagcacacactcatacctctctaatgatgttgtttcgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3232 - DNA, 5306 bp, Artificial Sequence
  Synthetic Construct, AT-75 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcaattcctgcggatgagcaggtcgtggttaggcgcaatggggagacggagctgacggagatcggccctctcgtggattcgctgatggattctcgcgagaccaggtcattcgacgatcacgaggtcacgctcgctccagacggcatcgaggttccctctctgtccagcgaggagaccgttgagtggaagccgattgaggaggtgtcacgccacgagacgccagacgagctcctgaggttcgagctggagtcgggcaggtctatcagggctaccaaggctcattctttcgtcacgcgccaggagaacgaggtggtcccagttgctggggaggagctggaggctggcgactggctccctgttgtggcttcgctggacgccaccgatacgcaggagacagtggacctgaggaagtacctcccggcgggcgattactggtacacttccgtgctcgccgacggcggggctgaggctgtcccaggcgggcccgaccagctgaggaacaagagggctgctctggaggctggcgagctcgctgagcacacagcttacccagtgcagggcactgtcgggctcccagagcagttccctctggacgaggagaccgggttcttcgtgggcgcttggctggctgagggcagcctcgcggatcattacgtttccatcagcaatgtggacgctgccttccagagccgcattaggtcgttcgccgagcgcttcgatctcacggtcaacgagtacgagaatgactccgggttcgcggctggctacgatatccggctgaacggcaccattctgagcgacttcctcagggctgcttgcacggacgatggcgagaagtcgatccccgggttcgctattggcgccaatgaggcgttcctcaaggggctcctgcagggctacttctccggcgatgggaacgtgggcaccaatgcgatcaggtcgtcttcaacaagcgacaggctgactgctggcgttgggctcctgctcgctaggttcgatgtgtacgccacactcggccagcaggaggactcacgcactctgagggtcccaaagaagcacgtttcccggttcgacaaccgcatcggcatggtcggggagaggggcgctgagctggaggctctcgctgagtcagctgactccgatgggccagacgctacagatcagatccctaacttcggcgatgctctggaggctgtggctgaggctgctgacatcccacagaggcaggtcaattcggccacgaagcggcagcgcattgacaggtctcggctggctaggctcgtggctgctgctgaggccgagctggacggggagcagtccgagctggatgcgctcaggcaggctgtcacaggcgacgtcgtttgggatcggatcgagtccattgagactgtggagagcgaccatgagtatgtgtacgatgtttcagtggaggggctggagactttcacaactgcggatggggtcgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3233 - DNA, 4796 bp, Artificial Sequence
  Synthetic Construct, AT-76 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcatcggggatactctcattccgctcgctgacggcaagtcttaccgcatcaaggatctcatggactgggggacggagttcatcgtttacgcgtgcaccccaacgggcaagattgtggctgctcaggctaccgctaagctcacgaggaggaacgctccactcgtgaaggtcatcctggacaatggcgaggagatcatttgcacacccgaccaccagttcatgctgcgggatgggacttacaaggaggcccagctcctgcaggcggagacatcactcatgccattctactccaagactgacaaggatggctacacactgattactcagccttactccagcaggtggcagaaggctcactggatcattgctaggtctggcctcctggggaaggtgccaaggttcgagggccagaagacgttcatccaccatcagaacttcgacgagagcgataaccgccccgagaacctggagttcatgggcaacagggaccactcggcgtaccatcgctctctggtggagaggaatcagcactggcattccgctgagttcgaggagaagagggtcgctagcctcgctcagaaggctaagacctcggagggctaccagtactacgccgagagggggacgcggaacatcttccagtacatggagcagcagccagagcacttcaagaatgcggtcgctggcaacgggaataggggcaagcagtacctcgttgagtacaacaagacagagaagggcagggggaagtcgcaggagatcgcgaaccggtactacacctgcgagatttgcggcgtcgacgttaagacgcccatcgggctgcacaaccatcggcgcaaggagcaccagtgcaatcataaggtggtcgccgtgaacctcctgaattacaccgaggatgtctactgcctcactgttccggagtaccacaacttcgctctcaaggctggggtcttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3234 - DNA, 4886 bp, Artificial Sequence
  Synthetic Construct, AT-77 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctctcgctctggataccgctctccctacgccttcggggtggactactatgggggacgttcaggttggggatcagctctacgatgcgcacggcaggccaaccacggtggtcgctgctaccgaggtgctcacggggaggccttgctacgaggtcgagttctcagacggctcccgcatcgttgccgatgcgcagcatcagtggctgaccgagtctagggctgctcggaagtcacgctgggctgctgacaagcagtacaaccgcgccaggaaccagaatatcgtcgcgagcgttgtgacaactgaggctattgctgggaccctcagggtgggcgctgaccagagggccaatcacgctgtcctcacggctgatccactgtccggcagcgacgtcgatctgccaatcccaccctacgttctcggcgcttggctgggcgacgggcactcggcgtctgctaggatcacctgcgagacgccagagattcctatgtacctggaggcttgcgggctgagggtcgaccatcagggcgcgatgctctactccctgaagttcccagacggcgatccgaggggcagcgtccagggcgttctcaggaccatcggcgtgctgaacgacaagcacattccagcggattacctcagggcttccgagggccagaggagggacctcctggctgggctgatggacacagatggcactgtcgttaggggcgttgggtcgtgccagttcgctgtgacaaacaagcggctcgcggacgatgtctacgagctcgtggtctctctggggtacaagtgcggcaggaccacgaggagggtgcagggcaggagcccagagacatcgacttgccatatcctcaatttctcgacggtggacgatgtcttcaggctggagcggaagcacctcctgcataaggaggagaggccagtgacacgggctaggatcgccaggcggtacattactgccgttcgcccaattgagtccgttcctgtgaggtgcgtggaggttgataatacagagcatctctacctcgccggggagagcatgattccaactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3235 - DNA, 5051 bp, Artificial Sequence
  Synthetic Construct, AT-78 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctccctgaggatgcgctggttcataccgctaaggggctggtccctattcgggatgttcaggtcggggatctcgttcagacaccgctcggcttccgcagggtggtcgacaagttcgatcagggcttccaggacgtgtacgagatcgagactaacgcgacctacccacgcgctacgctcaatcacaggcaggctgtcctggaggacgctaagggcgggatcgtttggaagcatattgcttcgctggaggccggcgataggctcctgcacaacaagcaggtcctcccgggcactgttacccatctgcccgcggacttcactgagagcaggccatcacactcccggaccgccaagtcgttcgttgtgcctgagctcacggctgaggtggcttggctgatcggcttcacacatggcgacggctacgtggctctcggcaggaacaagtacgataagccgtacgggcgggttgagtggtccatgaactccctggacgctgaggtcacctcccgcatccaggctaagattgatgctgctctcgctctgttcggcctctccgctgtccacagcatcacgaagggcgagaacacagctaagagcatctgctccagcattcggctggccgagtacttccaccgccatatcaagcagccaaatattcctctcactgtgccgtcattcatcctgcagggctccgtcgacattagggctgcttacctcgctggcctgatggactccgatggggctgtgaacaataggccaccacacctcatcacatcggtgtaccggtctttcattcgccaggtctcggtcgttctctcgtctctgggcatcgccgggaggctgaccacgacatacccccagaactctaattggcaggtcaagtacaacctcacgatcccggcgctgaaggagcgctacaatgctctcatttctccccattcagccaagggcgagctcaggcaggggctgaagatgtacggcttcacggttccaggggccgtgatgcgggagacgtacacatactctgagatgagggagatgggcttccaggggtcacggacagttgacgccaactacgagcgctacgtggcggaggctgacatctccctcgatattcctgtgactgtcaagggcctggggagctacgatcacgtgcagacctacgacattgaggttgatgaggctcattgcttctactgcgatggctacctcacacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3236 - DNA, 4322 bp, Artificial Sequence
  Synthetic Construct, AT-79 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggattacgagactgaggtcgtgctggggaatggggagcggaagaagatcggggagatcgtggagcgggctattgaggaggctgagaagaacggcaagctcgggcgggttgacgatggcttctacgctccgatcgacattgaggtctactcgctcgatctggagaccctcaaggttcggaaggcgcgggcaaatatcgcgtggaagcgcacagctccaaagaagatgatgctggtgaagactaggggcgggaagcgcattagggtcaccccgacgcaccccttcttcgttctggaggagggcaaggtggctatgaggaaggcccgggacctggaggagggcaacaagatcgccacgattgaggggctctccgtgagctgggacgaggtcgcggagatcctggagtacgagccaaaggatccttgggtctacgatctgcaggttccaggctaccacaacttcctcgctaatggcatcttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3237 - DNA, 4634 bp, Artificial Sequence
  Synthetic Construct, AT-80 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgcctgagacactgattattactgagaatgggacaaaggagatcggggaggtcgtggagcggtggatgaaggagctgggcgagatcgagtacgacgatggcatttcgtactctccggccttcgagaaggttgcgtccctgaacggcgggaaggtgaagatgctcccggtccgcagggtttggaagctgaggagcccaggcaagatgatcaagattcgctcagagtccgggaagcagatcaccgtcacgccagagacaaagctcctgactatcattgacggctcgctggagtgggtggaggctcgcaagctgaagaaggggaactacgttgcggtggtcaataaggagaggagcatcgtgcctattggcgacttcctcgctaagctcctgaagttctacggggtcgagctgaacctcaatgaggctgttgagcgcgaccaggccaggaagctcctggagaccctgaagtctaagggcctctcagatgtcacgatcgagattccagagaagctccggcgcttcatcaagtgcgaccgcgtgcgctacgtggatctggttgagatgctctccagcatggagggcgagctgaaggaggaggtcatgctcctgctctccgacgtgggggatatccacgaggtcattcaggagcggctgaaggagatcggcaagattctggagagcgacgcgtcgtgggagaggatcgctgaggtggaggaggttgtgcgggatggccatgtctacgatctcacagtggagggctctcattctttcattgctaatggcttcgtggttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3238 - DNA, 5012 bp, Artificial Sequence
  Synthetic Construct, AT-81 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcctccctgatgagaaggtcgtggttccctcggtcgggttcgtgacactcaaggagctgttcgagacggcttccaaggtcgtggagcgcgacgatgagaaggagatcagggagctcgacgagcggattaccagcgttaacggcgatgggaagacgggcctggtcaaggcctcctacgtgtggaaggttaggcacaagggcaaggtcatccgggtcaagctcaagaattggcacggcgttacagtgactccggagcatcccttcctcaccacgaaggggtggaagagggctgaccagctgaggccaggcgattacgtcgcggttcctaggttcatccatggcaacgaggacgagaagattttcctctcctacgtgaaggtcaagaagtctggcgaggagtggaaggagtacttctacctggcgggcaggaaggggaacatcgatgtcaatctcctgttcgttgctccaaagcgctacgtggtcgagttcctccgggggtacttcgaggagcgctccgaggtcaagggcgagagcgttatcgtggaggctcgggagctggtggagcctctcagcctggctctcctgaggttcggcatcttctctaagattcaggggtcaaagctcatcgtcaccggcaagcgcaacctggaggccttcaaggactacattggcttcaaggatgagagggagaaggccctggaggaggcgatcgagaaggtgaagggctccgaggtctacccgatcttcgaggagattcgcaggctccgcctcctgttcgggttcacaagggaggagctgggctcatacgctaagtacgagaactccgaggccccgacttacgaggagctcatggagatcctggacttcattgagagggggtcccccagcctctcgaagaagatcgcgattctggagggcaagctgaaggctgagctcagggtgctggaggaggagggcctgatcaaggacgggaagctcaccccactgggcagggagctcctggaggtctggcggaaccgcgagttcgattccaaggacgtcgattacatccggaacattgcggagacgctggtgttcatccccgttgagaatgtggaggaggaggagtacgacggctacgtttacgatctcactacggagactcataacttcattgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3239 - DNA, 4418 bp, Artificial Sequence
  Synthetic Construct, AT-82 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgcgctctactacttctctgagattcagctccctaacggcaaggagttcatcggcaagctcgtggatgagctgttcgagaagtaccatgacaagatcggcaagtacaaggatatggagtatgtggagctcaacgaggaggacacattcgaggtcatctcaattgggccagatctgtccgctaggaggcacaaagtgactcatgtctggcggcgcaaggttaaggacggcgagaagctcgtgaagatcaggaccgctagcgggaaggagctcgtgctgacgcaggaccacccggttttcgtgctcctgggcagggacgtcgctaggagggatgctggcaacgtcaaggttggggacgagattgcggtgctcaatacgcggcccgatttctcggtcctgtctccgcccgctatgccagagctcctgtctgagcctttcaattacgagctgtccagcatcggcgacgtcgcttgggatgaggtggtcgaggttgacgagattgatgccaagggcctcggggtggagtacctgtacgatctcacagtggatatcaatcataactacgttgctaatggcattgtcgtttctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3240 - DNA, 4829 bp, Artificial Sequence
  Synthetic Construct, AT-83 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcagcggggaggagacagtcgttattcgggagaatggggaggtcaaggtgctcaggctcaaggatttcgtggagaaggctctggagaagccaagcggcgaggggctggacggcgatgtgaaggtggtctaccacgacttccgcaacgagaatgtcgaggttctcaccaaggatggcttcacgaagctcctgtacgctaacaagaggatcgggaagcagaagctccgcagggttgtgaatctggagaaggactactggttcgctctcacccccgaccataaggtctacaccacggatggcctgaaggaggccggggagatcacagagaaggacgagctcatctctgtcccaattactgttttcgattgcgaggacgaggatctgaagaagatcggcctcctgcctctcacctcggacgatgagcggctgcgcaagatcgccacgctcatgggcattctgttcaacggcgggtctatcgacgagggcctcggggtgctcacactgaagtccgagaggagcgttatcgagaagttcgtgattaccctcaaggagctgttcggcaagttcgagtacgagatcattaaggaggagaacacaatcctgaagactagggacccgcggatcattaagttcctcgtcggcctgggggctccaattgagggcaaggatctcaagatgccatggtgggttaagctgaagccttcactcttcctggccttcctggagggcttccgggctcacatcgtggagcagctggtcgacgatccgaacaagaatctccccttcttccaggagctgtcctggtacctcggcctgttcgggatcaaggcggacattaaggttgaggaagtgggcgacaagcataagatcattttcgatgctgggcgcctcgacgtcgataagcagttcatcgagacgtgggaggacgtggaggtcacctacaacctcactacggagaagggcaatctgctcgccaatgggctcttcgttaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3241 - DNA, 5195 bp, Artificial Sequence
  Synthetic Construct, AT-84 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcccccctactgaggaggcggttttcaagttcggggataaggttaagatcgctactttcgaggaggtcgctaagaatttcaagttcgagcacaaggtcgagatcgacggcttcaagggggagtacagcattcccaacgacctctacgtgctgaccttcaatgatggcaaggccgagtggacccgggtcacgaagttcctccgcaggaagcacgaggggaagatccgcgtcattaagaccaagacgggcaggacgatcaggaccacgccagagcataagttcttcgtttacaaggacggggagctggtgaagaagagggctgacgagctggagccaggcgatgagctggtgctcctgtggcggttcgagtccgaggagacactcactgagatcaacctcctggaggctttcaaggacctgccacaggaggagaaggagaaggtctacgttcgggggattaaggacctcgatctgacgcctctcaaggagaagtacggcgacaaggtctactactgggcgaggcaggattcgatgccgctctctgtgttctacgagctcaacgtcgacctggataaggagttcaggctgggccgggacgctacaacttacgagctcccatctaagctgaagatcacaccttcactcgccaagctgattggctacttcgtgtcagacgggaactactccgacaaggatctccgcatcactgtgggccacgaggatgtcgagaaggagatcgttaatattctggaggagctcggcctgccatactcgttcctggagtgggaggggaagaccaagcagatcgttattggctctcgcctcctgaggctggtcttcaagcatgttttcaagatcccagagggggctccaaacaagaggctcccggagggcttcctgtccttccccttcgaggctaaggtggctctcctgagcggcctcttcaatggcgacggctacgtggtgcgcggcgagcaccatctgtcgatcgggtacgcgtccacaagcaagggcctcatcagggatattctgtacctcctggcttccctgggcattttcgcccgggtgtaccgcgtccctaaggagaagatgaagggggccaaccacgacctctacaagctgtacatcgcgggcaccgatctcgttcgcctggtggagctcctggagctcagggagggccatcgggagaagctgggcgagatcgggaatcgcaagccggcgagggtgaagaagatcgctgacttctacattgacgttgtggatgaggtcagcgaggaggagtactcgggctacgtttacgatctggaggtggagaatgaggggcatagcttcgttgctgcggatggcatcctcgtttcaaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3242 - DNA, 4385 bp, Artificial Sequence
  Synthetic Construct, AT-85 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcccaggcgatacacgcattctcgttcagattgacggggttcctcagaagattactctcagggagctctacgagctgttcgaggatgagcgctacgagaacatggtttacgtgcgcaagaagccgaagagggagatcaaggtgtacagcattgacctggagacaggcaaggtggtcctgactgacatcgaggatgtcattaaggccccagcgacggaccacctcatcaggttcgagctggaggatgggcggtctttcgagaccacggtggaccatcctgtcctcgtttacgagaacggccggttcatcgagaagcgcgctttcgaggtcaaggagggggacaaggtgctggtctcagagctggagctggttgagcagtccagctcgtctcaggataatccgaagaacgagaatctcggctccccagagcacgaccagctcctggagatcaagaacatcaagtatgtgcgcgcgaatgacgatttcgtgttctcgctcaatgctaagaagtaccacaacgtcatcatcaatgagaacatcgttacacatcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3243 - DNA, 5327 bp, Artificial Sequence
  Synthetic Construct, AT-86 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacgggggacgctaaggttatcgctaatggggagctgacaacgatcggggagctggtggagcgcatctcaaatggcaagctgggcccaacccccgtccggggcctcacggttctggggatcgacgaggatggcaagctcgtggagctgccagtcgagtatgtgtacaaggacaagaccagcgagctggtcaagatcaggacgaggctcggcagggagctgaaggttaccccataccaccctctcctggtgaaccgcaggaatgggaagatcgagtgggtgaaggctgaggagctgaagccaggcgacaggctcgctattccgtccttcctccccgccatgctgaacgataatcctctcgctgagtggctgggctacttcttcggcaacgggtacacagacagcgaggagcgcgtggtcttcgagtctaagtcaaaggagctcaggaagcggttcatggagctcactaggaagctgttccaggacgccgagatcaaggaggattccggcaaggtttacgtgtccagctcggaggttaagcgcctcgtgaagtcactgaacaaggattccatcccagagcaggcttggaaggggctcaggagcttcctgagggcgtacttcgactgcaatgctgagatcaaggataagatcattgtgtctacggctggcaaggagatcgccgagcagatttcatacgctctcgctggcctggggatcgtggctgaggtcgacgataaggggtcggtcatcatttctgacccggagaacgtttctaggttcctggatgagatcggcttctcagtcgaggagaagaaggaggaggctaaggccctgattaagaagtcgaccctcaacctgggcatctacgtggacaaggagctcatttcctacgtccgggagaagctcaagctgagcttctacgagaatgagacgatgtggtcgccagagaaggcccgcgagatcgcgtggaagctgatgaaggagatctactaccggctcgacgagctggagcgcttcaagaaggcgctctccaagagcgtgatcattgattggtcggaggtcgagaagaagaaggaggagatcagcgagaagacagggatctcggtgaacgagattctggagtacgccaagggcaagaggaagccgtctctggaggagtatgtgaagatcgcgaaggctctcggcgtggagctgaaggagacactggaggcgattttcactttcgggaagaagtacctgggctacgtgatctccgacgagattgagaccctggaggaggtcaggaaggaggagctcaagcggctgaaggagctcctgaacgacgagaagctgaagaagggggtcgcctacctcatcttcctggcgcagaatgagctcctgtgggatgagatcattgaggtcgagaagctcaagggcgacttcgttatctacgatctgcatgttccaaagtaccacaacttcatcgggggcaatctgccaactgttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3244 - DNA, 5654 bp, Artificial Sequence
  Synthetic Construct, AT-87 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacaggggacacaaaggtctacacgcctgatgagcgggaggttaagattagggatttcatgaattacttcgagaatgggctgatcaaggaggtgtctaatcgcatcgggagggacacagtcattgccgcggtttccttcaacagccgcatcgtgggccacccagtctacaggctcactctggagtccgggaggatcattgaggccactggcgaccacatgttcctcacccctgaggggtggaagcagacgtacgatatcaaggagggcagcgaggtcctcgttaagccaaccctggagggcacgccttacgagccagaccccagggtcatcattgatatcaaggagttctacaacttcctggagaagatcgagcgcgagcacaacctcaagccactgaaggaggcgaagacgttcagggagctcatcacaaaggacaaggagaagattctgaggagggctctggagctgagggctgagatcgagaacggcctgaccaagcgggaggcggagatcctggagctgatttctgctgatacgtggatccctcgcgctgagctggagaagaaggccaggatctcaaggacccggctgaatcagattctccagcggctggagaagaaggggtacatcgagcggcgcattgagggccgcaagcagttcgtgcggaagatccgcaatggcaagattctccggaacgccatggacatcaagcgcattctggaggaggagttcggcatcaagatttcatacaccacggtcaagaagctcctgtccgggaacgttgatggcatggcgtaccgcatcctcaaggaggtcaaggagaagtggctggttcgctacgacgatgagaaggcggggatcctggctagggtggtcggcttcattctcggcgacgggcacctggctaggaatggccggatctggttcaactccagcaaggaggagctggagatgctggctaacgacctccggaagctcggcctgaagccgtcggagatcattgagcgcgattcgtcttcagagatccaggggcggaaggtgaagggccgcatctacatgctctacgtggacaatgctgccttccatgccctcctgaggttctggaaggtggaggtcgggaacaagaccaagaagggctacacggttccggagtggatcaagaagggcaatctcttcgtcaagagggagttcctcaggggcctgttcggggctgacggcaccaagccctgcgggaagcgctacaacttcaatggcatcaagctggagattcgggctaagaaggagtccctggagcgcacggtggagttcctgaacgacgtcgccgatctcctgagggagttcgacgttgattcgaagatcacagtgtctccgactaaggagggcttcatcattaggctcatcgtgacacccaacgacgccaattacctcaacttcctgacacgggtggggtacgcctacgcgaaggatacttacgccaggctcgtcggcgagtacatccggattaagctcgcgtacaagaacatcattctgcccggcatcgctgagaaggccattgagctggcgacagtcactaacagcacgtacgcggctaaggttctcggcgtgtcgagggacttcgttgtgaatcggctgaaggggacacagatcggcattactagggatttcatgaccttcgaggagttcatgaaggagcgggtgctgaacggctacgtgatcgagaaggtcatcaagaaggagaagctcggctacctggacgtctacgacgttacttgcgctcgggatcatagcttcatttccaatgggctcgtttctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3245 - DNA, 5027 bp, Artificial Sequence
  Synthetic Construct, AT-88 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatcgatggcaacgctaagattattttcgagaatgagggggaggagcatctgacaactatggctgagatgtacgagcgctaccgccacctcggcgagttctacgacgagaactacaatcgctgggggattgatgtgtccagcgtcccgatctacgtgaagtccttcgacccagagacgaggagggtggtcaagggcagggtccgggccatctggaagtacgagctgggcgaggagattccgaagtacgagatccgcacacacaagggcactaagattctcaccagcccatggcatcctttcttcgtcctgacaccagacttcgaggttatcgagaagagggcggacgagctcaaagtgggcgatatcctgattggcgggatgcctgacggggaggatcacgagctcattttcgactactggctggctggcttcatcgctggcaacgggaatctcgacgattcggagagggagtacaaggcccgcgagctcctggatggcatcgagaacgggattccgcccaagatcctgaggaagggcaagaatgccgtcctctctttcatcacgggcctgttcgacgctgaggggcacgttaacgataagtcaggcattgagctcgggatggtgaataagaagctgatcgaggctgtcacacattacctcaacagcctgggcatcaaggcccgcatgagggagaagcggcgcaagaatggcatcgactacattatgcacgtggaggagtactcgtctctcctgcggttctacgagctcattggcaagcatctgcagaacaatgagaagaaggagaagctggagatcctcctgcacaagcataacggcggggcgttcgatctctcactgaacttcaatgctttcaaggagtgggcctccaggtacggcgtcgagttcaagaccaacgggaatcagatcctcgctatcattggcaacgagaaggttagcctgggccagtggcacgcgagggggcatgtgtcgaaggctgtcctggttaagatgctccggaagctgtacgaggttactaagaacgacgaggtgaaggagatgctccacctgatcgagtccctggaggttgtgaaggagatcaccattacgaacgagcccaagaccttctacgatctgacagtggataagtaccagaactacctcgccggggagaatggcatgattttcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3246 - DNA, 5144 bp, Artificial Sequence
  Synthetic Construct, AT-89 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcacaggggacactcgcatcctgacggagaaggggctgattcctattgaggagatcgtgcatgagacgggcaagaagccaaaggtggtcacacacgctggcctcaaggacatcattgagacttacgataacggggagatggaggttttccgcgtgaccacggaggacggctacgagctcaaggtgaccggggaccataagttcctggtcttcgatgagaacggcaatccaacgctcaagcctctgaaggagctcaaagtgggggactacgtctacatcctggctccagagtggaagggcggggagtatgtggagctcgatacaaacatcgagctgaagggcaaggggtacaacgttaatctgccctcgaagctcgacgagaagctggcgtacctcctgggcatcatctacgctgatgggcacatccgccattacttcgagaacggcaagcgcaagaactccaagatcgagatctacctccaccaggacgagaccgagatcaaggagaaggtgaagaggtacttcaaggagatcttcggcattgagccaaaggagttcctcaaggaggagcagcataaggtcatcctggttattccttccacgaagattgtcaagttcctggagatcaacggcctcctgaaggacaagagcgagaatattcgggttccggaggctatcttccgctcccgcccatctgtgatcgctgcgttcctggctggcttcttcgacggcgatgggtcgatcgatcagaactaccggatcgccttcaagtccattagccgcgagttcatcaaggaggctcagctcctgttcctcgccctgggcatcgtgacatccattcaggagtacaacccgcccaatccaaacaataagacagtttacactctccgggtgcagactcgcgacatgaagatcaaggcgttcaacgtcctcaaggagagcgttaagctgtcgaagattatgaaggaggctatctctaagctggaggagaacggcaagaataagaagttctcattcccgttcaacgccatctaccacattaaggaccccaagatcagggcgaagattcagcgggattacaagatcctctcatacaattccaaggtgacccatagggccttcatcaacaatattctcaagctgaaggaggagctcggcctggacgatgaggaggtcaagtacttcgagatgctgagcaagctctacccaaccaagatcacgaagattgagcctctggggaaggcgcacgtctacgatctccaggttgaggatgttcatctgctcacaggcaatggcatctacacaagcaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3247 - DNA, 4976 bp, Artificial Sequence
  Synthetic Construct, AT-90 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggtcggggagacaaggattctgacgcctgagggctacatcaaggctgaggagctgttcaagctcgccaaggagcggggcaagatggaggccatcgctgtggagggcattgctgagggcggggagccatacgcgtactctctggagatcctcctgcctggcgacaagcaggtcaagtacgagaccgttcacgggaacgctgtggaggtcgccgatccggtttcagtgcccgcctacgtgtggaaggtcggcatgaaggaggttgcccgcgtgaggacaaaggagggctacgagatcaccgccacgctcgaccataagctgatgactccggagggctggaaggagatcaaggacctgaagccaggggataagattctcctgcctaggttcgaggtggaggaggacttcggctccgagagcatcggggaggatctcgcgttcgtcctgggctggttcattggcgacgggtacctcaacgttaaggataagcgggcgtggttctacttcaatgctgagaaggaggaggagatcgcctggaagatccgcgagattctggctaagaggttcgagatcaaggccgagccacaccgctacggcaaccagattaagctcggcgtcagggggaaggcgtacgagtggctggagtccatcgttaagaccaacgagaagaggatcccggagattgtgtaccggctcaagcccaatgagattgcctcattcctcaggggcctgttctccgctgacggctacgtggacaatgatatggctatccgcctcacgtcgaagtctcgggagctcctgcgcgaggtccaggatctcctgctcctgttcggcatcctgtccaagatctacgagaggccgtacaagcgggagttcaagtacaccacgaaggacggcgaggagcgcacatacacaactgaggggtactacgagctcgtgatcgcgaactactcccggaagatcttcgctgagcgcattggcctggaggggtacaagatggagaagctcagcctggagaagatcaaggtcgacgagcccattgtcaccgttgagtcggtggagatcctcggcaagaagctggtctacgacttcactgttccagagcatcacatgtacatttccaatgggttcatgagccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3248 - DNA, 5138 bp, Artificial Sequence
  Synthetic Construct, AT-91 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgcctgggtcaaaggtcctcacggagcatggctactggctgaaggtggaggagctgccggagaagttcaagctgcagggcgttaaggtgtacaacctggacgagggccacaacgatacaagcaatgttgctttcgtggctgagagggaggtggagactggcgagatggccgtccgcgttaccacggagtccggcaggatcattgaggggagcgaggaccatccagtcctgacccctgagggctacgtttacctcgggaacctgaaggagggcaatctcgtgattgtctacccgttcgagggggttgagtacgaggagaggaagggcgtgatcctcgacgaggatgcgttcaaggacgaggatccccaggtgctctccttcctgagggagaagggcctcgtcccactgcgctgggacgatccccgcatcgggacaattgctcggatcctgggcttcgctttcggcgacgggtacctcggggagatgggcgggaggctcacactgactttctacggcaaggaggagacgctccgggagctgaagaaggacctggagcgcctgggcatttcggccaacctctacgtgcgcgagtctatcgagacaactagcggccactcggaggggaagtccctcagcatcgagctgcgcgtcacatcgaggtctttcgcgctcttcctggagaagctcggcatgccgagggggaagaagactgagaaggcgtacagggtgccaggctggatcctggaggctcctctgtgggtcaagaggaacttcctcgctgggctgttcgctgctgacggctcgattgtcgagttcaagggcaacaccccgctccccatcaatctgacgcagtcaaagtccgacgagctcgccgagaatctggtggagttcctcggggatgtcgccaagctcctggcggagttcggcatcgagaccacgctgtacgaggttaagtccaagaagggggtgacctaccgcctctctattgtcggcgaggactcaatcaggacgttcgttgagcggatcaattacgagtacgatcccgagaagaaggtgaagggcctgattgctgccgcgtacctcaagctgaaggagaggatcgtgaaggaggcgcatgaggctgtcaaggacgatttcccaaccttcgaggagttcgctaaggagaggggctacgagggcgggttcgtcgctgagaaggtggtcaaggtcgagagggttaagcctgagtacacgaagttctacgatattggggtttaccatgaggctcacaacttcattgctaatggcatcgtcgttcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3249 - DNA, 5117 bp, Artificial Sequence
  Synthetic Construct, AT-92 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggacactctcgtgctgacaaaggagttcgggctcatcaagatcaaggacctctacaagattctggacggcaaggggaagaagacagtgaacggcaatgaggagtggacagagctggagaggccaatcactctgtacggctacaaggacgggaagatcgtcgagattaaggctacccacgtttacaagggcttctccgccgggatgatcgagattcggacccgcacgggccgcaagattaaggtcacgcccatccataagctcttcacaggcagggttactaagaatgggctggagatccgggaggtcatggccaaggacctcaagaagggcgatcggatcattgtggcgaagaagattgatggcggggagcgcgtgaagctgaacatccgcgtcgagcagaagaggggcaagaagatccggattccggacgtcctcgatgagaagctggccgagttcctcggctacctgatcgctgacgggaccctcaagccaaggacggtggccatctacaacaatgatgagtctctcctgcgcagggctaacgagctcgccaatgagctgttcaacattgagggcaagatcgtcaaggggcgcacagttaaggcgctcctgatccactcaaaggctctcgtggagttcttctccaagctgggcgtcccgcgcaacaagaaggccaggacttggaaggtcccgaaggagctcctgatctcagagcccgaggtggtcaaggcgttcattaaggcttacatcatgtgcgacggctactacgatgagaacaagggggagatcgagattgtgaccgctagcgaggaggctgcttacggcttctcgtacctcctggctaagctggggatctacgccatcattcgcgagaagatcattggcgacaaggtctactacagggttgtgatttccggcgagagcaacctggagaagctggggatcgagagggttggccgggggtacacgtcgtacgatatcgtcccagttgaggtggaggagctctacaacgctctgggcaggccttacgctgagctgaagagggcgggcatcgagattcataattacctctcgggggagaacatgtcttacgagatgttcaggaagttcgcgaagttcgtcggcatggaggagatcgctgagaaccacctcacccatgttctgttcgacgagatcgtggagattcggtacatctccgagggccaggaggtgtacgacgttactacggagactcataatttcattgggggcaacatgcctactctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3250 - DNA, 5777 bp, Artificial Sequence
  Synthetic Construct, AT-93 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcgccagatactatggttcgcactactaacggggacaagccaatcagggacatcgcggtcggggatcagctcttcgatcacgaggacaggccagtgcagtgcctcgctgctgaggctatccagacctcccggatgatgaaggttacctacacgggctacaacagcgtgtcgaagtccagcttcacatgcactccagaccacatcatgaccctcgttgcgtacggggtgaagcctttccgccattctaactcaaatagggtgacctggtggacgaggtgcgacaggacggagctgggcgctgatgctgtcgagatcaagtgggatgctgccatgcacgacctctacacagagtaccgcgagcagctgggcaggaggccaactgacgctgaggtccggaagtacctcaaggctatcaccagcacgcgcgtggtcccagattcggaggacgatgactctcagagggtcgaggagacgtaccagtcgcccgttctcattaagctcctggcgaagctgaaggctatggatgtggacgtcgatggcgaggacgagtctgttgtgctcatgctcctgcagcagcacatggaggactacctggagcacatgatcccagagcctgaggatatttccgacgaggataacgatgacctcatcattgacctggatacaaataggaagcggaagatcggcacaatttctactctgtcgtctcgcatctcagacaagactttcaggcagtccccgagcattaagtcatcccccgtgaactctcagcagcagtcacagaatgaggcttcgcagtctaccgtcccgacgtacgcctcggttctcaccgaggatgaccaccgcgagatgttcgcgccagtgcggtcaaagctggctgtccgcgaccctaagtgcaagtgccagaacctctcctgcaagggcctgaggcgcgtcagcacagttttcgagacttcggagcaggctgacctggctctggagctcctgagcggggatcactaccgcgtcgttgacccatgcgccgtgcaggatatggaggtcttcacaatgactctggaggagtaccaggctacctgcacggctcctatgacgcagcataagtccaagctgcgcctctacaggagcccgctcaggttccagccataccagggctcagtgtccccagtcccaatcgacccgttctggttcgggttctggctgggcaacgggaccaagaacaattccgagattacaagcactgatcccgaggttgaggtgtacacgcaggcgctcgtggataggctgaatagggactcgatcccaccaggcaaggctccactgaaggtctctaagtacaagatcgacattggcaccaagcacgtgtacaagggggaggagatcaagaccacgaaggtcgcccatcgcctcagggtcatgagcaccgtttcgaacctggacaagacgcactggaatccagtgcatgatggcctgagggagctcggcctcctgggggacaagtccggcgggatccctgactgctacatgaacgcggatgagaatacaaggctggctgtgctcgccggcctgattgagtcagacggctggctctcccacgggctgaactgctacggcttcgggcagtacacctacgagctcaagaagctggtcgaggacgctcggaagctggctctctcctgcggcatccagtgcaaccccattttcgagaggaagaatggcaaggatcggccagagcctgggtggttcttctacatgggcaggggggtcgagaagttccagccacatctcctgctccctcggaagcgcatgaccatcccgttcacaactagcaagaacagggacgttcggccattcgacgtggaggatgctggcgacggggagttcaggctcattgaggtttcaggggagctcttccagctcgcggataggactgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3251 - DNA, 5549 bp, Artificial Sequence
  Synthetic Construct, AT-94 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgctaaggggacactgctgctgcgctacgatgggacaaaggtggaggtggagaatgttcgggagggggatctgctgctgggcccagacggcgggcctaggagggcgttcaacattgtgggcgggagggaccggctctacaggatcaagatggagggcgggaaggaggatctggtggtcaccccaaatcacatcctggtcctccatcgcgagaagagggacggcgtcgataaggtttacgctaggccattcgctctcccactcctgcaggaggacgccaccgacgatggcgaggatctgtcggagatctctgcgattgagcacttcgacaccatggagatcacggctgctgacttcgcttccctcgatccgaacgagcgcaagctgtacaggctcttcacgagcccaggctacgagctgaatgggaggccagtgcccattgacccgtacttcctgggcctctggctgggggatcgctccaggaccaagtccagcatctacacgaaccacgaggaggagatccgggagttcattgcggaccatgctgccgagctcgatctgcagctcgtgtcatacgtctccaatcgcccatccctcgcggctatgaagaacggcaatcagctgcctctcaggcaccaggctaggcagacgatcaggaagcagcgcattgccgcgaagagcatcacacagccaggcggggctaggtcgtcttcataccctgccaccaacggcgggctgtccagcaatacagtgactagcctccactcgcgggagcgccatccactgtccgagtcgtctgctgccgcgacgatgaacctcctgccacgctccacaagcgtctcgacttctgttgctgcccagcctaagtcatccatgagcacattcatcactgacgctattctcccttcggagagctcgaacatctctgtcatttcagattccggcatcgagattagcaagtcttcaaagatgctgtcggaggaggaggccgacctggatctcttcgacattgattcggaggacgaggagatcgaggacctcgatgagaagaagaacgttagcaatgtggacgagttcccgaagcggcgcaggatccactacctgaggaccggctgccggacgtacggggagctctgcccaggcgaggaggaccagatcctggaggatattgttggcaggccagacgggaccacgtctgtggagtcactcctgctcgctctggaggctctggggctccatacctgcggcacgaacgacagcgggtcggataagaagcggatcccctcagtgtacatgaagaactcccgcgccgtgcgcctggctctgctcgctggcctcatcgactctggcgggtggtatgtggattcagagaacacattcggcttcagccagactgaggactctaattcaaccctgatctgggatgttgtgaccctggctaggagcctcggcttctccgtcagcacaaagcggcgcatgactcacaagccgaccaggacgcagcataaggcgcaggagttcgctcagatttcgggcaacgtcgcggagatcccatctctgctcgctagggagaggggcgttgagaggccaatctcccaggcgcacagcttcaagatcaaggacattcagctggagacagaggccactgagtgggcggggttcagggtggatcaggatcagctctacctcaggcatgacttcctcgttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3252 - DNA, 4313 bp, Artificial Sequence
  Synthetic Construct, AT-95 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgctaaggggacaaggctgctgcgctacgatgggacagagatcaacgtggaggacgtgcgggagggggatcagctgctcgggccagacggcgagccaaggagggcgttcaacatcgtttccggcattgaccggctctaccgcgtgaagatcggcggggagaaggaggatctcgtggtcaccccgaaccacattctggtgttctacagggagggcccatccgatgggcctgagaatgcggagcggcagacagtcgagatcactgccgcggagttcgctaccctcagcacggaggagcgctccctgtacagcgcgttcacctcgccagctgtcgagaagggcgctgaggggtcagctgctcagatgcattccttcaaggttgaggacatttcgctggagtctgagaagacggagtgggccggcttcagggtggataaggatcagctctacctcaggcatgattacctcgttctgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3253 - DNA, 4931 bp, Artificial Sequence
  Synthetic Construct, AT-96 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgccagattcgctcgtggtcgtcaatgataaggttcaggagatcggcaagctgacagaggagtgggggcgggaggtcgggttcctggagtactccagcggcatcttctacgctccgtacctcggcagggggatttcactggacctcgttacagggaaggtgaagccgtctgtggtctcaaaagtgtggaagctgaagtcccccgaggagctcgtcaccatcaagaccattacgggcaaggagatcacagtgactccagagaccaagctcctgacgttcaacgggacactggagtggaaggaggcgggcaagatcaagcctggggattacgtgctgactgtcaagaagctccacatcaatggcaagcaggagaccctggacgagaagctcgcctacaagagggggctgagcctctcggatccactggagttcttctcctcctccgagaggactatctccgcgtacctgaagggcattttcgacaaggtcggcaggctcgttggggataccgccgttatcaaggtggacaaggatatggcgaagaggctgcagatcctcctgctcaggctcggcattgtctccagcgttgacgagacgggcaaggtcatcatcgggcgcgagtacatccagaagattctgggctacaacgtttccgttgtgacgcacgaggtcgagctcttcagggagttcatcgccgagatttccaagttctacggcacaagcgaggaggacgtctactcgtctctgcatgagaagggcgagctcgatatcgggactgtcccagttgagctgcctgagggcctccgggaggagatcaatcgcgagagggctacgtacagcgagctggtgaagatcgcccaggagattaaggacgagaagctgtacaacaagctcgcgtggatcctgtcggaggtcacggaggaggaggctaagattaaggagaaagtgaatacactcaaggtcatcctgtcatccgatctcattccggagcgcgtggagtcggtcaagatcattaagtctccgtacccctacgtgtacgatctcacagtggagggctctcattctttcattgctaatggcttcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3254 - DNA, 4991 bp, Artificial Sequence
  Synthetic Construct, AT-97 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgctgccggaggagaaggtcgtgctgcctgagatcgggctggttacgctgcgggagctgttcgagctggctaatgaggtcgttgtcaaggacgaggagaaggaggttcggaagctgggcaagatgctcacaggggttgatgagcgcggcaacgtgaagctcctgaatgccctctacgtgtggagggtcgcgcacaagggcgagatgatccgggttaaggtgaacgggtggtactccgtcaccgttacgccggagcatcccttcctgacgaatagggggtgggtgaaggctggcgagctcaaggagggggactacatcgctattccgcgcagggtctacggcaacgaggatctgatgaagttctcgaagatcgccaaggagctcggcattaagggggacgagaaggagttctacctggccggcgcgtctctcgatatcccgattaaggtgctcttcctggctccctccaagctggtcagcgccttcctccgcggctacttcgacgcgaagggggtggtcagggagaactacatcgaggttccactgttcgaggatctccctctcctgctcctgaggttcggcatcgtctcgcggattgagaagtctaccctcaagatctcaggcaagcgcaacctggagctgttcaggaagcacgtggggttcacggactccgagaaggctaaggccctcgatgagctgatctccaaggccaaggagagcgagaggtacccaattctggaggagctgaggaggctcggcctcctgttcgggttcacacggaacgagctgcgcatcgaggagaatccaacttacgaggtgctgatggagatcctggagcgcattgagaggggctcacctaacctggcggagaagatcgctgtcctggagggccggattaaggaggagaactacctgcgcatcctggaggaggagggcctcattgagaatgggaagctgaccgagctcggcaaggagctcctggaggtctggaggaaccgggagttcgactcgaaggacgttgattacgtgaggaacatcgtggagaatctggtcttcctccccgtcgagaaggttgagcggatcgagtacgagggctacgtctacgacgttactacggagactcataatttcgttgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3255 - DNA, 5396 bp, Artificial Sequence
  Synthetic Construct, AT-98 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctctctacgatttctcggttattcagctctctaatgggcggttcgttctcatcggggatctcgtggaggagctgttcaagaagtacgccgagaagatcaagacctacaaggacctggagtacattgagctgaacgaggaggataggttcgaggtggtctcagtctccccggacctcaaggcgaataagcacgttgtgtctcgggtgtggaggaggaaggtccgcgagggggagaagctgatccgcattaagaccaggacgggcaacgagatcattctcacacgcaatcatcccctgttcgccttcagcaacggggatgtcgttaggaaggaggctgagaagctcaaagtgggcgacagggttgccgtgatgatgcggccgccctcaccacctcagactaaggcggtggtcgacccagctatctacgttaagatttccgattactacctggtgccaaacggcaaggggatgatcaaggtccctaatgacggcattccgcccgagaaggcccagtacctcctgtctgtgaactcataccccgttaagctcgtgagggaggtcgatgagaagctcagctacctggctggggtcatcctgggcgacgggtacatttccagcaatggctactacatctcggcgaccttcgacgatgaggcgtacatggacgctttcgtctccgttgtgagcgatttcatcccaaactacgtgccttccattaggaagaatggggactacacaatcgtcactgttggctctaagattttcgccgagatgctctcacggatcttcggcattccgcgcgggaggaagtccatgtgggacatccccgatgtcgttctcagcaacgacgatctgatgcgctacttcatcgccggcctcttcgacgcggatggctacgtggacgagaatggcccgagcatcgtgctggtcaccaagtcggagacggtcgccaggaagatctggtatgtgctccagcggctgggcatcatttcgacggtttctcgggtgaagtcgcgcggcttcaaggagggggagctcttccgggttatcatttctggcgtggaggatctcgctaagttcgccaagttcatcccactgaggcactcccggaagcgcgctaagctcatggagatcctgcgcacaaagaagccttacaggggcaggcgcacttacagggtcccaatctcgtctgacatgattgctccactgaggcagatgctcgggctgaccgtggctgagctctcaaagctggcctcctactacgcgggcgagaaggtcagcgagtcgctcatccgccatattgagaaggggagggtgaaggagatcaggaggtcgacgctgaagggcatcgctctcgctctgcagcagattgctaaggatgtgggcaacgaggaggcttgggtcagggctaagaggctccagctgatcgctgagggcgacgtctactgggatgaggtggtcagcgtcgaggaggttgacccgaaggagctgggcatcgagtatgtgtacgatctcacagtggaggatgatcataactacgttgctaatggcattctcgtttctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3256 - DNA, 5033 bp, Artificial Sequence
  Synthetic Construct, AT-99 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcgggggaggaggttattctcattgagaaggacggggagaagaaggttttcaagctgcgggagttcgtggacgggctgctgaaggaggcttctggcgaggggatggacggctcaatccgggtggtctacaaggatctccagggcgagaacatcaagattctcaccaaggatgggctggtgaagctcctctacgtgaaccgcagggaggggaagcagaagctcaggaagatcgttaatctggagaaggactactggctcgccctgaccccggagcacaaggtctacacgatcaagggcctgaaggaggcgggggagattaccaaggacgatgagatcattcgcgtcccgctcacgatcctggacggcttcgatgttgcggagaagtccattagggaggagctggagaggctgagcctcctgcccctcaactcagaggattccaggctggagaagatcgcgggcattatgggggctctcttcggctcgggcgggatcgacgagaacctcaatacactgtctttcgtgtccagcgagaagaagactatcgagcagttcgtcaaggctctcagcgagctgttcggcgagttcgactacaagatcgaggagaaggagaactccatcatcttccgcacctgcgataagcggatcgtgacattcttcgctactctgggcgccccagttggggacaagtcaaaggtgaagctcaagctgccatggtgggtcaagctcaagccttccctcttcctggccttcatggacggcctgtactcgtctaaccgcaatgataaggagatcctggagattacccagctgacggacaacgtggagacattcttcgaggagatcagctggtacctctcgttcttcggcattaaggccgaggcggaggaggacgaggagaaggataagtacagggctcggctcactctgtcatccagcatcgacaacatgctgaatttcattgagttcatcccgatttcgttctctcccgccaagagggagaagttcttcaaggagatcgagaagtacctggagtactccattcccgagaagacggaggacctgaagaagcgcgtcaagagggttaagaagggcgagcggcgcaacttcctggagtcctgggaggaggttgaggtgacctacaatgttactacggagacaggcaatctgctcgctaatgggctcttcgttaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3257 - DNA, 5405 bp, Artificial Sequence
  Synthetic Construct, AT-100 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcacaggggacactaaggttatcgctaatgggcagctgttcgagctgggggagctggtggagaagctctcgggcgggcggttcggcccaacgccagtgaagggcctcaaggtcctggggatcgacgaggatggcaagctccgcgagttcgaggttcagtatgtgtacaaggaccgcaccgataggctgatcaagattaagacgcagctgggccgggagctcaaggtgacaccataccaccctctcctggtcaaccgcgagaatggcgagatcaagtggattaaggccgaggagctgaagccaggggacaagctcgcgatcccgtcgttcctccccctgattaccggcgagaaccctctggctgagtggctggggtacttcatgggctctgggtacgcttacccatcgaactctgtgatcaccttcacgaatgaggaccctctcatccgccagaggttcatggagctgaccgagaagctcttcccggacgcgaagatccgggagcgcattcatgctgatggcacgcccgaggtctacgtggtctccaggaaggcttggagcctcgttaactcaatctccctcaccctgattccacgggagggctggaaggggatccggtcgttcctgcgcgcctactctgactgcaatggccggatcgagtcagatgctattgtgctctccacggacaacaatgatatggcccagcagatcgcctacgcgctggcttcgttcgggatcattgcgaagatggacggcgaggatgtcatcattagcgggtcggacaacatcgagaggttcctcaatgagattggcttctctacacagtcaaagctgaaggaggcccagaagctcatcaggaagactaacgtgcggtctgacggcctgaagatcaattacgagctcatttcatacgttaaggacaggctccggctgaacgtgaatgataagcgcaacctgagctacaggaatgcgaaggagctgtcgtgggagctcatgaaggagatctactaccggctggaggagctggagcgcctcaagaaggtcctgtccgagccgatcctcattgactggaacgaggtcgccaagaagagcgatgaggttatcgagaaggccaagattcgcgcggagaagctcctggagtacatcaagggcgagaggaagccctccttcaaggagtacatcgagattgccaaggttctggggatcaacgtggagaggacaatcgaggctatgaagattttcgccaagaggtactccagctacgcggagatcggccggaagctggggacttggaacttcaatgtgaagacaatcctggagtccgacactgtcgataacgttgagatcctggagaagatccgcaagattgagctggagctgatcgaggagattctgagcgacgggaagctcaaggagggcatcgcgtacctgattttcctcttccagaacgagctctactgggatgagatcaccgaggtcaaggagctgaggggcgacttcatcatctacgatctgcacgttccaggctaccacaacttcattgcgggcaacatgccaacagtcgttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3258 - DNA, 4949 bp, Artificial Sequence
  Synthetic Construct, AT-101 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcatcctgacactctcattctcacatcacagggggttcgcaagatcaaggagctctcgcgggagggggaggttttcgctctcgacttcaacctgaagctctccaaggcgaagtacaggctcctggagcgggacgctgatgagcagatgtacaaggtgaccctcctggacggcacggagctgtacctcacagccgatcacccagtgctcgtctacagggagggcaatctggctttcgttcctgccgacaagctccgggagacggatcatgtggtcctggtgctcaacaagtctgctcgggacaattacggcttcctcgatctcctgctggagattactgactcacaggaggattacgccatcctggagaacggcgagaccctgtcgctccactctctgaagatgctcgtggagcgcggggagatcaaggacattgcggttgtgggcttctcgcataacaatttcgggaaggtcatgctcagggatgagctgtggtacctcatcggctacctggctgggaagggcggggagatcaagggcaacggggtcgttatttccagcaggacgaaggagatcgtcggcctgacaaagagcctcaacatcgacctgattgagaccgaggaggggatcgtgctctcaaataagtccttcgtccggctgctccacctgatccattacacgccgcgcgtccccgaggtttacggcatcattaacaatacagagtggctcaaggccttcctggcgggctactacgacgccactctgctggaggggctgaccctggaggctctctacaagatcaaggtctacctgcagctgctcggcatccgcgcgaagattgaggacaacaagctcaaggttcacctggaggatctccagcggttccgcgagctgctcggcaagttcagccgccgcaagctctacgtggagacttcgcaggttccggtgttcaccgacttcgatgagcgctcctacgacttcccaaggatcctgggcggggatatctacatcattggcatcaagagcattgagaagttccattacaaggggaaggtctacgatctcgtcgtggagaactaccacaacttcattgctaatggcattgctgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3259 - DNA, 4610 bp, Artificial Sequence
  Synthetic Construct, AT-102 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtcgcgcctgatactctcattaacacagacaacgggcgggtggagatcggcaagttcgtggaggagtggatgaaggaggtcggggagatttcggaggagggcatctcttacgccccgtgcttccgcaaggtcgagaccttcaaggacgggaagattgttgagagcccaatccgcagggtgtggaagctccgggctcctaagaagctggtgcgcattaagacagagaacggccgcagcatcgccctcacaagggagactaagctcctgactatcaatgatggcgagctgtcgtgggtcgaggctggggaggtgaaggtcggcacctacgttgggacggtgaagtcagagaaggacgtgattccaggcgctgggaagaccatcagggatgtctccaagctctacaacatggagatggaggtcaaggactacctgacgagggaggaggttcggaaggcgattgagaagctggaggagatcatgaacccgatgaatatcaagattcccggcgtgcaggagtcctacgaggagctcctgcggaagctggagaccacgaacgatgagcgggttcgcaatgagacactcatcctcctgtccgacgtgagcgatgcccacgagctggcgaaggagaagatcgagaagattaaggagatcgtgaactccgaggtccattgggagaaggtcaccgaggttggcgaggtggacggggtcgagtatgtgtacgatctcacagtggagggctctcataatttcgttgctaatggcttcatcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3260 - DNA, 5162 bp, Artificial Sequence
  Synthetic Construct, AT-103 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgctgccggaggagcgggttattctgcctgactacgggcctattactctggaggagctcttcaatatgacaaaggagacagtgttcaaggacgaggagaaggaggtccggaagctcggcatccgcatgccagtggctggcgtcgatgggcgggtgcgcctgctggagggcccctacgtttggaaggtgcgctacaaggggaagatgctcagggtcaagctgaaggactggcacagcgtggctgtcacaccagagcatcccttcctcaccacgcggggctgggtgcgcgctgaccagctgaagcccggggattacgttgccgtgccaaagatcctccctgggaaggacgataaggagaagttcctccagtatgtgcacgagaagctgaagggcaaggttcatattaagctgccgtccagcgacgaggagtgggagacattcttctacttcgccggcactatcttcgggcgcgagaactcggtgaatccagagggcctcacccacgaggtcaaggctctcctggagctcttcaaggttctgttcgagtacccgagggaggtcctccgggttctgttcatggccccggtgcgctacgtggcgaacttcctccgcggcttcttcgacattaacggctacgtcaatggggaggagctgagggtcgaggttaggggggctccacatgaggttctggaggagctctccctgatcctcctgaggctgggcatcgtgtccaagatctaccctacgagcctggctatttcgggcaggaggaacctggagctgttccggcgctacatcgggttctcggagaagcagaaggccaaggagctggagggcatcattaggcggtctgagaactcagagtcctacccaattttcgaggagctgcgcaggatcaggctcctgttcggcttcacccgggcggagctctcgtctacgatcccactgtactctaagtacgagtcaaaggaggctccttcatacgagatcctcatgaagattctgaatacaatcgagaaggggtctaaggacctcaacaagaagatcactattctggagggcagggtgcgggatcacgagtacattgaggagttcaagcgcgagggcctgatcaaggacgggaagctcaccgagctgggcaaggagctcctggaggtctggcgcaacagggagttcgactccagggatgtcaactacctccggaatatcattgagaacttcgttttcctgccggtggagaagatcgaggagttcgagtacgatggctacgtctacgacgttactacagagactcataatttcattgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3261 - DNA, 5255 bp, Artificial Sequence
  Synthetic Construct, AT-104 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggactctaaggtcctgacggagaaggggccagtggagattcggcatctcaattcgggcatgatcgtgggcatcaatggcttcaagagcaggttcgtcaagttccaggagctgcaccaggtcaagtaccaggagtacggggttaagatccggacccagctcggcttcgaggtgaagtgcaccagggagcatcggttcctcacgattgacaagaacggcgagctgcgctgggttgaggcttggaggctcaaggagggcgattacgtggggatcattcgcaagctgccgtctcccaactcaaaggttctcatcctggacttcctcccggagtcgacgtacctctggctgaataaggagttcctcaagaagctgaaggtctctatcaaggagaagttcgggtcaattaagaactacgccaaggagcggggcttcaattccagctacctggtgaagcagctcaacgggctgtccccattccgctggggcaggctcagggttatcctgaatgatgtgtcgatcgagatttctcgggacgatatcgagcgcattacatcacgcaggggcaagtactccctcccaccagagctgactcctggcatcgctaggctcctggggttctggatggctagcggctcgctcaaccgcaataccctgatcttctactcgcaggacaagaagattctggagcgctacgaggatctgtgcaagcgcgagttcagggtcaaggggcggatcaaggcccaggacaagggcacgtacatcctggagattccctcgtctctcctgtctttcgtcttcaagaacctcgcgcgcccaaagctggaggttccaccgatcatctacatcctgcctgagaagcacaaggaggagttcctcgctggctacttcgacggcaacgggttcatcaagattgagaatgggaggatccattccctcggcttcttcgccttcaaccgcaagttcgcggaggggatcagggatattctcctgcagctcggcatcctgtcatccattaatgagcagacattcgaggtgagcatcattgagggcgagaagttcctgaagatcgtcaactcctggcgcagcaattactacaaggagtgggaggacgtgatcccgaacctggagaagaggctgaaggagattgaggagaagctcggctaccccgggacttacaatcggcgcgagatcaggcggtccgagctcaaggcgatcattaagctgtacgagaaggtggctcgggagaggggcctgaacgacgtcctcaaggagctgagctacctcaaggagctgtcggagggcgacatcttcttcgataggatcaccagcattgagccagtgtacctcgatgtcgcgtacggcatcatcaactcagagacaggcaactacgtggttaatggcttcgtttcaaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3262 - DNA, 5252 bp, Artificial Sequence
  Synthetic Construct, AT-105 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcaggggaggaggttattatcgtggagaagggcaaggaccgcaaggtcgttaagctgcgggagttcgtggaggacgctctcaaggagccatccggcgaggggatggacggcgatatcaaggtgacatacaaggacctgcgcggcgaggatgtcaggattctcactaaggacgggttcgtgaagctcctctacgtgaacaagcgcgagggcaagcagaagctcaggaagatcgtcaatctggacaaggattactggctcgccgttacacctgaccacaaggtgttcacttctgagggcctgaaggaggcgggggagatcacggagaaggacgagatcattagggtcccactcgttatcctggatggccctaagattgcctcaacatacggcgaggacgggaagttcgacgattacatccgctggaagaagtactacgagaagactggcaacgggtacaagcgcgccgcgaaggagctgaatatcaaggagagcaccctcaggtggtggacgcagggcgctaagccaaactcgctgaagatgatcgaggagctggagaagctgaatctcctgcctctgacctctgaggactcacggctggagaaggtcgccatcattctcggcgcgctgttctcagacgggaacatcgatcgcaacttcaataccctctccttcatctccagcgagcggaaggccattgagcgcttcgtggagacgctcaaggagctgttcggcgagttcaactacgagatcagggataatcatgagtccctcggcaagagcattctgttccggacctgggaccgcaggatcattcgcttcttcgtcgcgctgggcgctccggttgggaacaagacgaaggtgaagctggagctgccgtggtggatcaagctgaagccctcgctcttcctggccttcatggacggcctctactcgggcgatgggtctgtcccaaggttcgctcgctacgaggagggcatcaagttcaacgggaccttcgagattgctcagctgacggacgatgtggagaagaagctccccttcttcgaggagatcgcttggtacctctccttcttcggcattaaggccaaggttagggtggacaagacaggggataagtacaaggttcggctgatcttctcacagtccattgacaacgtgctcaatttcctggagttcatcccgattagcctctcgcccgctaagagggagaagttcctgcgggaggtcgagtcctacctcgctgctgttccagagtcgtctctggctggcaggatcgaggagctcagggagcacttcaaccggatcaagaagggcgagcggcgcagcttcattgagacctgggaggtggtcaatgtgacctacaatgttactacggagacaggcaatctgctcgctaatgggctcttcgttaagaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3263 - DNA, 5210 bp, Artificial Sequence
  Synthetic Construct, AT-106 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctatcctccctgatgagtggctgcctatcgtggagaatgagaaggttcggttcgttaagatcggggatttcattgatcgggagatcgaggagaacgccgagcgcgttaagagggacggcgagaccgagatcctggaggtgaaggatctcaaggccctgtccttcaatcgcgagacgaagaagagcgagctcaagaaggtcaaggcgctgatccgccacaggtactccggcaaggtgtacagcattaagctcaagtcggggcgcaggatcaagattacctcaggccattccctgttcagcgtcaagaacggcaagctcgttaaggtgcggggggacgagctcaagccaggcgatctggtggtcgttccaggccgcctcaagctgcctgagtcgaagcaggtgctcaacctggtcgagctcctgctcaagctgccagaggaggagacgtctaacatcgtcatgatgattcctgttaaggggcgcaagaatttcttcaagggcatgctcaagacactgtactggatcttcggcgagggggagaggccaaggactgctggcaggtacctcaagcacctggagaggctcggctacgtgaagctcaagaggaggggctgcgaggttctcgactgggagtccctgaagaggtaccggaagctgtacgagacactcatcaagaacctgaagtacaacggcaatagccgcgcttacatggtggagttcaattctctcagggacgtggtctcactgatgccgatcgaggagctcaaggagtggatcattggcgagccgagggggccaaagatcggcactttcattgatgtcgacgattcgttcgcgaagctgctcgggtactacatctccagcggcgacgtggagaaggatagggtcaagttccactccaaggaccagaacgtgctggaggatatcgccaagctcgcggagaagctgttcgggaaggtgaggaggggcagggggtacattgaggtcagcggcaagatctcgcatgctattttcagggtcctcgctgaggggaagcggatcccggagttcattttcaccagccccatggacatcaaggtggcgttcctgaagggcctcaacgggaatgctgaggagctgaccttctcgacgaagtctgagctgctcgtcaaccagctcatcctgctcctcaactccattggggtgtcagatatcaagattgagcatgagaagggcgtctacagggtttacatcaacaagaaggagtcgtctaatggcgacatcgttctggattcagtggagtccattgaggttgagaagtacgagggctacgtgtacgacctctctgtggaggataatgagaatttcctcgtgggcttcgggctgctctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3264 - DNA, 4346 bp, Artificial Sequence
  Synthetic Construct, AT-107 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctagggatacggaggtttactacgagaatgacacagttccgcacatggagtcaatcgaggagatgtactcaaagtacgcttccatgaacggcgagctcccgttcgacaatgggtacgcggtcccactcgataacgtgttcgtctacaccctggacatcgctagcggcgagattaagaagacgcgcgcctcgtacatctacagggagaaggtggagaagctcatcgagattaagctgtccagcggctactcactcaaggttacaccatcccacccagtgctcctgttccgggatgggctgcagtgggtgccagctgctgaggtcaagcctggcgacgtggtcgttggggtccgcgaggaggttctcaggaggcggatcatttccaagggcgagctggagttccatgaggtttcgtctgtgaggatcattgattacaacaattgggtctacgatctcgtcattccagagactcataacttcattgctccaaatgggctcgtgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3265 - DNA, 5060 bp, Artificial Sequence
  Synthetic Construct, AT-108 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccccagacacgctggtttcgctctcggacgggcggattattgagatcagggaggcggtggagaactcggaggagtcgctgctcgggatcaacggcctgaagccgaaggaggccaaggcgctcaagttctgggagatcgactgggatgggccgatcaaggtcatcaagctgaagaatggccacgagatcaaggctaccccagaccatgggctcctggttatgagggatgggaagatcggctgggtgtcggctaagaacattcgggagggcgactacgtcgccttcatctacaatctcgggcaccgcggcgggaagaagtacacgctcccccagctcctgaaggagctgggcatctccgagtacgagaactccagctcgcaggagctcaacaatcgcgagcaggagatggactccaagcagatcagcattgagctggatgagaggttctggtacatcttcggcgtgattctcggcaaggggaccctgaagggggacaaggtggtcatcttccagaaggatgtcaagccggttattgaggaggcgctgcccttcgtccggatcttcgagtcggctgaccacatcggcttctctcatctcattctggctgaggtcttccgcaggctcggcgttggggagggcaagctccactccctggtgttcggcctgagggaggagtacatcaacgctatgattgccgggtacttcgacgctagcggcaccttcctcaggagggctgtcctgacgagcaagcgcggcgatatcctcaggatgctgtcggtgtacctctaccagatcggcattgtcaacaatctgaggagggacgagcatgctggcgtgtgggagctcatcatttctgatctggagaagttccgcgagaagatctacccttacctcaggattaagaagtcacagttcgacaaggtctactctatttcaaagaacgagggcgatttcctcccggttgcgtctatcttccggaagctgaagttccgcgacggcttcaagaatcggatcctcgacgaggagattccacgcgatgaggtggcgaaggtcctggagtacgctgaggactcacctgagaaggagttcctcaactccctggttgaggccagggtgacatgggttcgggtggagaagatcgaggagaggcattacactggcaagctctacgacttcacaactactacagagaacttcatttccaatggcatcgtctcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3266 - DNA, 5000 bp, Artificial Sequence
  Synthetic Construct, AT-109 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgcctgggacaagggtcctgactgagcatggctactggctgaagattgaggagatgcctgagaagttcaagctgcagcggctccgcgtctacaacatcgaggagggccacaatgacttcagcaaggtggtcttcgtggctgagagggaggtcggctcggaggagaaggctatccgcattgtcacagagtccgggaaggttatcgagggcagcgaggaccatccagtgctcactcctgagggctacgtgtacctgaggaacgtgaaggagggcgattacatcctggtgtacccgttcgagggggtcccctacgaggagaagaagggcgtcattctcgacgagtccgctttcgagggcgaggatccgcaggttgtgaagttcctgcgcgagaggaacctcatcccactgcagtggaaggaccctaaagtgggcatcctcgctcggattctggggttcgctctcgcgaatggctacatcagcgagaacgataatctcaccttccacggcaaggaggaggtcctgagggaggttcggaaggacctggaggagctgggcatcgaggcgattgtcgctgaggaggataagctcaaggttacgtctagggagttcgctttcctcctggagaagctggggatggcccacgactcaatcccggagtggatcattgagggccccctctggattaagaggaacttcctcgctggcctgttcggggctaatggctcgatcgttgagttcaagggcgacgtgccgctgcccattaccctcacgcattcgcgggagctcctgaacgatgtctctcgcatcctggagggcttcaaggtgagggccaagattaagatggggaagaatggctcataccagctcgtcatcgaggacgaggattccattcgcaacttcctggggaggatcaattacgagtacgacccagagaagaaggccaggggcctcattgcttacgcctacctgaagttcaaggagctcatgaaggggaacctgatgaccttcgaggagttcgcccgggacaggggctacgagggcgggttcgtggcggagaaggtcatcgaggttaagagcgtgaagccggagtacgataagttctacgatattggggtctaccactcagctcataatttcattgctaatggcatcgtcgttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3267 - DNA, 4958 bp, Artificial Sequence
  Synthetic Construct, AT-110 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtggacggggacacactggtgctgacaaaggagttcgggctcatcaagatcaaggagctctacgagaagctggacggcaaggggcgcaagattgtggagggcaacgaggagtggaccgagctggagaagccaatcacggtctacggctacaaggacgggaagatcgttgagattaaggccacccacgtttacaagggcgtgtccagcgggatggtcgagatcaggacccggacgggccggaagatcaaggtgacgccgattcaccgcctgttcacaggcagggtcactaaggacgggctgatcctcaaggaggtcatggctatgcatgttaagcccggcgataggatcgccgtggtcaagaagattgacggcggggagtacatcaagctcgattcgtctaacgtgggcgagatcaaggtcccggagattctcaatgaggagctggcggagttcctcggctacctgatggctaacggcacactgaagtcggggatcattgagatctactgcgacgatgagtctctcctggagagggtgaactccctgtccctcaagctgttcggcgtcggcgggcggattgtccagaaggttgacgggaaggcgctcgtgatccagagcaagccactggtcgacgttctcaggaggctgggcgtccctgaggataagaaggttgagaactggaaggtgccgcgggagctcctgctcagcccatcgaacgttgtgcgcgccttcgttaatgcgtacattaagggcaaggaggaggtcgagatcaccctcgcttccgaggagggggcttacgagctcagctacctgttcgctaagctgggcatctacgtgacaatttctaagtcaggggagtactacaaggtgcgcgtctcgcggaggggcaacctcgacactatcccagttgaagtgaatgggatgccaaaggtgctgccttacgaggatttcaggaagttcgccaagtccatcggcctggaggaggtcgcggagaatcacctgcagcatatcattttcgacgaggtcatcgatgtcaggtacattccggagccccaggaggtgtacgatgttactacagagactcataatttcgtggggggcaacatgccaactctgctccacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3268 - DNA, 4952 bp, Artificial Sequence
  Synthetic Construct, AT-111 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccgctgacacaaggctcgctacacagcatgggctggtccctatcgggtggctgcaggctaatgggggggctctggactgcacggtggacaggagggctctgggcgaggataggagggggacagttactcgcgccgctgtgccagcgttcctcagcgctggccaggctgaggtcttcaaggttaccacggccgagggctaccagatcaaggccacagcgtggcacgagttctacactgctaggggcaagctcaagctgtcggagctcaaggctggggacgagctgtgggtccagtccggcaaggggcagttcggcgctcagggcagcggggctctcggcctcctgatcgggctgattaccggcgacgggcatttcacgaaccgcggcaaggatgagcaggctgccgttatctccctgtggggcgaggagaggcagctcgctgacgatatcgccggctctgtcaatgccctcattgctgggacctcactggctccgcgcgactacctcgtgaagccagttgctgtggccgagcggaacatggtcttcattcgctcaaccatgctcgtcagggttctggatggctacgggttcaatggcgagacgaagctggaggtgccagaggtggtctggaggggctccgaggcttgcatgaggggctacctccaggggctgttccagacagacggcactgtgaacgtctccagcaattcccagagctgctcggtgcggctgtcgtcttcacaccgccctctcctgcaggatgttcaggtgctcctggcgaacttcggcgtcttctcgcgcatccatgagaggagggaggctggcccaaggtctctcccagacgggcagggcgggcagagggattacctgtgccagacacagcacgagctcatcgtggacggcgagtctcgcgaggcgttcatgagggagattgggttcctcctgcccgctaagcgggagaagtacgacgcttgggtcgccgataaggcgctcgttaagacccagaggttcgcggctaccatcacggcgattgagccagctggcgtggagcctgtctacgatactactcagccagacggcaacacagtcatcttcaatgggctcgttacggggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3269 - DNA, 5198 bp, Artificial Sequence
  Synthetic Construct, AT-112 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctctgcggatcatgaggttctcacatctacagggtggaaggctctccccgctattaaggatgcggatcaggttatgacgctggacctccagacgggcacacagcagtggaactcggtgcaggctaccacgaggttcgcgcgggagggctcactctacaggctgaagtccgacgatatggatgcggtctgcaacgagtctcaccgctggtacctcaatactaaggaccagccaacaacttacaccgctttcaccacgcagcagatgctggataaccagctcgtggctctgcgcaactcctccggcaaggctacggaccagtggaaccacgagtccgggacaactacccacacgaaccataatatccctacagtcggccataacgggaatgttatgttcagctggccagactgcccatggctcccacgcgagttcgtcgctgatgaggcgtgcaacctcgactggtgcaggttcatcggcctcgtgatgggcgacgggtcgattgatcatgtcacggacgctcagggccaggagcactacagcatccagattcatcagagggctgggaacccagcttcgaacgctaatacagaggatgtcctggagaggctggctgctaagctgccaaatttcgtggtccacccatcctgcgttagcggcgcggaggagaagcatacttggaccatcaaccaccgggacatgtaccatttcttcctccccatgatgcgcggcccacagtcctacgaccctctggataacgccatgtgcaggacctaccaggctccagattaccaggccctctcgcggtctgacaatgagcctatcattccagtgccagctgactggaagaccggcaactggtggcacctgcgcaggtggatcaattacccatggctcttctcgctggcccagtctcaggcgagggctatgattaagggcatggctgccgcgaacggggattggtcactctccctgaaggctaggctggacaccggcgattctggggttgtgagggttttcagcaattcgatccccctcatgcacgacatgtcagtgctgggcctcctggccgatactcgcgtgaacattggcgtcgaccataagaaggggcagatgcagctccaggtccctgttaccatgccggcgctcctggcttggtgcatctctttctcattcgcgaactccgacctggctgtggctgctccaaagcctgaggcgtacgataatccgaggcacgacggcttcgtttactgcctcacggtgcccaacgggaatttcctggcccggcgcacagtcgagtacagcgataatgataagattcaggaggtcattgatgctgctcagaagcctttcttcacaggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3270 - DNA, 4970 bp, Artificial Sequence
  Synthetic Construct, AT-113 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttactgcggatacatgggttatgactacggcggggccggctcaggtttcggagctgacggggcggtctttctcggctgtcgttgacggcaaggcctacgcggtgacatccgatgggttcttcaggactggccacaagccagtcctcgctctgaggaccagggagggccctgctctccgcctgacggctgaccatagggttcgcagggtggctaggaggaccaggtacacgctggaggctgagtggaccgaggctgggcagctgcagccaggcgacgagatcctcctgcacgatcatagggctctcggcgggtgggagggggctggcacacacgctgaggggtacctcctgggcctcctgatcggggacggcactctcaagtccgataaggctgtcattagcgtttgggctccagagctgaaggtggctggcgggggcgctgtcgcctacgcgcagaccggcgccgggggcatcgttcaggccgcggaggctgctgctgctacgctctcccacagggtcgacttccggggcttccagaggtcgatttctgggaggggcgaggctaggatggcttctggcgccgtgcggcacctggctcatgagatggggatgaggccaggccataagacaatcaccacggccatggagaaggcgtccagcgtcttcactgaggggctcctgaggggcctcttcgacgctgatgggagcgttcagggctcgcaggagaagggcgtgagcctcaggctgtcacagtccgatctctcgctcctgcagaccgctcagaggatgctcctgaggctgggcatcgcctccacgatctacccgaacaggcggctcgctcaggctaggccactgccagacggcagggggggcctgcgcgtctacgagacagcgtcacagcacgagctcgttatctccgctgataatctgaggatctacgccgagcggattgggttcgccgacacggataaggctgacaggctcgatcaggctctgggctcttacaaccggtcactcaatcgggagcgcttcacagtgactgtcgagtcgctgaccgaggagggctctgaggacgtgttcgatgttactgtggcggatattcatgctttcgatgctaacgggctctacgttcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3271 - DNA, 4928 bp, Artificial Sequence
  Synthetic Construct, AT-114 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgcgggggttctctcgtcaaagattaagattcctgggggctggaagactatgggcaatattcgggtcggggatgaggtcgttacgccagacggcgggacagctaaggtcctcgctgttcacccacagggcgtgactaaggtggtcagggtccatttcaaggacggccggtacacagacgtctcgcccgatcacctctggaaggttcgcaggcaccattggtgcaacgataaggccatggcgaagctgactcgcgaggaggtggaggagagggtgtggagggtcatcaccacgaacgagctcaaggactacattggcctgagcacgaaggtttacgtgcagctcatcgagccggagaggaatgcggataagccattcaagattcacccttacgttctgggcgtgctcctgggcgacgggtgcatctcccagaaggctgtcgatattaccaagccataccagcagctcttcgacaaggtgcagagcctcctgcctgagcacctggagtgcgtctggaggccaaacaggaagggcgacggggagcccaagaccttcggcatccgcttcaaggatcggcgctccgagcagcacatcaattggcatattcgggacggcctgaaggagctcggcctgtacgggatgcgctcttggggcaaggtcatccccgaggagtacctccacgggtcagctaagcagaggctggagctcctgcagggcctcctggacaccgatgggacggttgataagcataagtcagtgtccttctccagctcgtctaagctcctgagcctcggcgtccagtacctcgttaggtcgctgggcgggatggctaggctgcaggagcgcacaccacactacactcataatggcgagaagagggaggggcggaccgactaccgggtctacatccgctacccgaggcccgaggagctcttcacgctggatcacaagagggagcgggcggtgtcccaccagcatacagagactctccgcctgcaggtcacccatatcgaggagaggcctgacgaggagacgcagtgcattactattgatcatccagatcatctctacattacggacgacttcatcgttactcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3272 - DNA, 5177 bp, Artificial Sequence
  Synthetic Construct, AT-115 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggggacaaaggttctcatggctaacggggatgacaagaatattgaggacatcgcggtcggggaggaggttctcgggaaggacggcctcccacgcgaggtggtcgctctgcctcgggggagggagacaatgtacgaggtcagcgagaagactcagcacagggcggagaccgttttcggcacggcctcgtacacatgcaacgcgactcacaagctcgtgctgcagaccaatcagagggttaacatcacgaatcatgtgctccggggcgagtctcagacctcagttacgtacttccagatgaagaccgctgtggctgacgggagggagattgagctcccaaagctgtgcacgaagtccttccagcactccagccatggccgggagaacgcttggaagaaggccgaggtcttcgcgtccacaatcagccgcgaccccattgattggactgcggaggctcgcgacatctctaggctcggctaccacgtgcgcagggctaccaggcagctctggagcccagttctggtggagaaggaggtcctggctcctatgatcgccaagcggggcttcgatgagtccattgcgccgtacatggcttacctcgtggggctgtgggtcggcgacgggtactccgatagggccacattcagcatcgacattcaggatgtggagatccacgagaggattaaggacttcgcctcacatgctggcctgactccaaggatcgcttgctacaagaagtccagggatgctaccatttcactccacaactccgagacgcggggcaagaatgtccgccagaacctgaatacggggaacctcctgtggtcgctcctggctgagatctgcggcaagaaggagaatgagatgctcttcaagctggtgccaagcttcctccgctcagagtccatcgcggtccgggagtacttcatttctggcctggtcgactcagatgggcacgttaagcgcgacgaggctgataagtgctacagcgccacagtgaagactatctaccctgccgtccgggacggcctcgtcagcgttgcgcgctcgctggggattcagacaagcgtgtcggtcgaggaggccaaggaggtcaactcggttaagcatcaggagtcttacgccatctacatggccaactcctccgctctcgactcggtgctgtctaagtgcgctgctccaaggaagcgggctgaggagcccgtttgcgtgaacagggagccgcacccctacacgttccacatggtcgagaaggaggaggacgatttctacggcatcactctctcagaggactcggatcatcagttcctgctctctaatctcgctctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3273 - DNA, 5114 bp, Artificial Sequence
  Synthetic Construct, AT-116 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgcgggggacactctcattacactggctgacgggcggcgggttcctattcgggagctggtctcgcagcagaatttctcggtctgggcgctgaacccgcagacgtacaggctggagagggctcgggtctcccgggccttctgcacaggcatcaagcccgtttacaggctgaccacgaggctcgggaggagcattagggctactgctaatcaccgcttcctgaccccacagggctggaagagggtggacgagctccagcctggggattacctggctctcccaaggaggatccccacggccagcacaccaactctgaccgaggctgagctcgctctcctgggccacctgatcggcgacgggtgcactctccctcaccatgtgattcagtacacctctagggacgctgatctggctacgctcgtcgctcatctggccacaaaggtcttcggctcaaaggttaccccgcagatccgcaaggagctcaggtggtaccaggtgtacctgagggctgctaggccactcgctcctggcaagcgcaacccgatcagcgactggctgagggatctcggcattttcgggctgcggtcgtacgagaagaaggtccccgcgctcctgttctgccagacgtccgaggccatcgcgacattcctgaggcacctctgggctactgacggctgcattcagatgaggagggggaagaagccatacccagctgtgtactacgcgacctccagctaccagctcgcgagggatgtccagtcgctcctgctccgcctgggcatcaacgccaggctcaagaccgttgctcagggcgagaaggggagggtgcagtaccatgtgaaggtctccggcagggaggacctgctcaggttcgtggagaagattggcgctgtcggggctaggcagagggctgctctggcctcggtttacgactacctctctgtgcggacgggcaacccaaatcgcgatatcattcctgtggctctgtggtacgagctcgtccgcgaggccatgtaccagaggggcatctcgcaccggcagctgcatgcgaacctcgggatggcttacggcgggatgacactgttccggcagaatctctctcgggctcgcgccctgaggctcgctgaggctgctgcctgcccagagctgaggcagctcgctcagtcagacgtctactgggatccgatcgtttccattgagcccgacggcgttgaggaggtgttcgatctcactgttccagggccacataacttcgttgctaatgacatcattgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3274 - DNA, 4946 bp, Artificial Sequence
  Synthetic Construct, AT-117 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacggcggagacatgggttatgacggatgagggggctaggcaggtctcggctctgctggatcggcctttcagggcggtcgtgaacggcatcgcctacgattcaggcgagcacgggttcttctgcaccggcctcaagccagtgaagaggctgtccaccgcttgcgggaggcacctcaggctgacggctgaccatctggtccggaaggtggtcggcaagacgaggtggaggcaggaggttgagtgggtgccagctggcgacctcaggcctggggatgaggtgaagctgcacgaccatcgcaccgcgatgattcagacgaggcctgaggatgagaggggctacctcctggggctcctgatcggcgacggggttattcgcgacgataagacactcatctccgtgtggccacaggaggagtgcattggcgctcagccactggggcaccccgtcatgcataaggttgaggctctcctgagggacctcccacacagggctgatttcgctggctggcagaaggtcgagggcaggggggagtacaggatcggcacagctgctctcactgctctggctgctgagtacggcctcacacgcgggaggaagaccatcacgccggagattgagggcgctgagactgctggcttcggggctgctgtcctcaggggcctgttcgacgctgatggcagcgttcagggggctcaggagaagggcgtgtccgtcaggctcgctcagagcgacctggctctcctgcaggctgctcagaggatgctcgctaggctgggcatgaacgctgtgatctacgagaatcgcagggaggcgggcagggctttcctgccagacgggaagggcgggcaggctcacttcgagaccaaggcgcagcatgagctcgtcatctcgggcgagaacctggcgacataccaggagcggattgggttcactgatgtggctaaggctaggaggctcgctgtcgctctgtcgggctacaagagggccctcaatcgggagcgcttctctgccgttgtggcggacgtcgttgacgatggcatggcggaggtgttcgatgttcaggttccaggggttaatgctttcgatgctaatggcttctacgttcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3275 - DNA, 4874 bp, Artificial Sequence
  Synthetic Construct, AT-118 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcaagcgggggacagaggtcattatgttcgatgggacaactaagaaggtggaggacgttatcgtgggggacgttctcatggggccagacagcacccctaggaacgtgctctcgctgggcagggggagggagatgatgtacgaggtgaagccacggaagggcgagtcctacacggtcaatgagtcacacatcctctccctgcgcaccacgacaggcattgcgaaggggtcctggcctgacaacacagtcttcgatatcagcgttcgggactggctcaagctgccaaagtatgtgactggccctaatgggtacctcaagggctggagggtgccagtcgatttcccaaggaaggagcaggacgaggctctcctgccaccatacctgatgggcctctggctgggcgacgggacttccagctcgggcgctatcacctcgggggagaatgagaaggagattagggcttacctggagtcttacgctgctaggaacggcatgcagatcaggaaggaggggctgacttggtctatttcacacggcaacaccgggcacaagaagcatggcttcacgcatgcgctcaagagcgctggggtgctgaacaataagcacatcccgcataactacaagtgcggcgataggaggcagaggctggagctcctggctggcctcctggactctgatgggtactgcgatctctcaaaggctggcttcgactggatttccgttagcgagaggctggccgacgatttctgctacctctgccggtcgctgggcttcgctgcctacaagaagaagacctgcaagcgctgcgcgaacacagacgtctggggcgattacttcagggtttcggtgtctggggacttctccgaggtgccattcgtcaggggcaggcatcagaatctccccaagcgcaacatcaataagaacgttctgaacgtgggcatcgagtccattacccccgtcggcgttgacgattacttcgggttcacaattgatggggattcaaggttcctcctcggggatttcacagttactcataataccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3276 - DNA, 4844 bp, Artificial Sequence
  Synthetic Construct, AT-119 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccgctcagccgctggattcgctcgttctcgcgcctacggggttccgccgcatgggggatctcagggagggggatgaggtcgtggtccctaacggcgagatcgcgctgattgacggggtcttcccacagggcgtcagggacgtttggcggatcgtgctgagcgatggctccagcgtcgagtgcgacgatgagcacctctggattgtcggcacatcgtgcgggtggcataggggccagactccgaaggtcatgaccacgcgcgagatcaggctcgacacattcaaggccaacggctcctccaagtggtatgtgccagctgctaccccagtcgacctggggccagatgttggcctgccactcgacccttacctcttcggcctcctgctcggcgatgggtccttccgccacaatctgaggctcagcaccgtcgacgatgagatcagggacgctgctgctgatgctgtggctccggactgccggctggtgcccgtcaccggctcgcgctgcgattacacgatccagctcaagcagcggtctggcggggttcgcaacccagtgattcaggctctgaggaggctggacctctgggggaagacctcccacggcaagttcatccctgaggatttcaagaacacgtctattaagaataggctgtcactgctccaggggctgctcgacacagatggcactgttcatgccgacgggatgtcagtgtccctcaggagcgcttcgctgaggctcgctgaggacgtcgcttggctggttcgctctctcggcgggagggctcgggtcctcccagagaaggctgccttccatgtttcagtggctctgccagacgagtacgctcctttccggctctcccgcaaggctgatcgcgtgaggccaaggcccaagtacaatacgttccggaggggcatccgcgctgtggagtatgtgggcaggaagccggctcagtgcatttctgttgggcatccttcacatgcttacgttacggataatttcactgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3277 - DNA, 5327 bp, Artificial Sequence
  Synthetic Construct, AT-120 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggggacacaggttatgatggcggacgggtcggacaagtcgattgaggatattcagctcggggagaatgttatgggcaaggacggcacaccaaggactgtgatctccctcccccgcgggaaggagacaatgtacgaggtctgccactccagcaccaagggcaccacgaaggacacgctgatgaactacgtgtgcagcgggaatcataagatcgtcatgcagacaccacagcagatcggcattactgagcacggcattgacgggaagacctacacgagcgtctcgtacttcgctctcagggattcgcagcacggctaccctatcgttaagaagctgacgaagtctttcgagcatcagcagcacggcgggaaggagcagaccctcatcacggttaacaatttcgtgtcgtctctgaagtcggagccgattaactgggacgtggaggccaagcattacgagtccctcggccactacgtcaagaagtgcagctaccagctgatcaacccggttttccatcagagcggcaagctcgcccaggagattgcgtcgctgaattactctaaggacaaggctcccctcctggcctggctcatcggcttctgggtgggcaacggggctatgcgccactctcagttcgtggtcgagtcacaggacattgagctcgtcaacaggatccaggatattgcgggcctcctgaatctgtccgcgacaactgcttgctactactctggctcaaaggacgatgaggccaagctcgcgaagctgaactcatccagcgctgagggcttcgaggacgacctggaggggaatccaagcgtgaaggagctcgcggacatggataggctgtccgagagcaagacagcgactctgcctaccgctttcggcgtcgagaacatcgacgagctcatcatttcactgggcgaggggaggggcaacgggaatgtcttcgcccaggttatcggctctttcgggattgacctcgctgacaaggatacactggttactaagatcgcccatgagctcgctggcgacgccttcgaggtgagggagcagttcgtggctggcctggtcgatgctgctggctacgtgcgcaaggacgtgtacgatcacgcgtcagaggctaccatctccacggagtcgaagtctaccgtcctcggcctggttaagattgccaggtccctggggatcaagattaccgtgacgtcagacgattccgacgatagcgacgagcacgatcatgcgcactgcggccatgaccacgggtcgtcttcatcctacacagccgtcatgactggggatgcgctcacgaacagcatgcggttctgcgcgatcggccgcaatagggttgctgccaaggagttcatgcgccaggctgtgcccttctacttcagcctggagaagaagtcggaggacgattactacggcatcacagttccagataatacggataagcagtacctgctctcttctatggctctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3278 - DNA, 5270 bp, Artificial Sequence
  Synthetic Construct, AT-121 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcagtctcttacgatacgccagtcctcatcagggaccctattaacaagatccatctcgtgaagatcggggagttcattgataagttctacgaggagggcgaggagaggacggctaagcacgtgaatgggtactacgtcctctcccatgacggcttccaggtggtctggaagccgatcaagtatgtgctgcggcaccgcacaaacgagatctacgagatcatctacgagggcgggggcaagctggaggctaccggctcgcattctgttttcgtgctcgacccggatacgctggatatcgtcgagaagcccgttatgctcctgaataagggggagtacctggtttctttcaacggcgtgaaggagaataaggaccaccagacaatcgacctcattgatctggtttcggactacaacgatgtctacgttgataatatcccatctgagctcaagaagcatactgggggcaggaacccaatccctctcaagcagtacatgatcctgaggaagcgggtcattacaaagaagaacaatagcctcatcaagctgcgcaggtcgaagtacactctcccgattcggctcgtgctggacgagaagctcgccttcctgttcggggcctacatcgctaacggctgcgtcaaggagaggagggacaagctgatctgcttcaccttcggcaagtccgccaagaacatcgcggataaggtcatgaatattatgtacgagaagttcaacatcaagccattcattgacgatagggggacatacatcatctacgagtaccctcacactctcctggcgatcattttcgagaagctcctgggccgcaagctggaggagaagaagatgccagagatcctgtggtccagccctaagagcgtgattcgcgcgttcttcgagggcctcagggcttactcccagcgcaccctgaggaggaggtacacgagctacaccacggctaacaagaatctcgcctaccagctcctgtggctggctaggttcgctggcttctactcggtcctcaaggaggagaaggaggccgggaagaacaatggcaagacgtactaccatgtgatcgtctacctggaccagtcttacaggaagccgaacgcgtcagagcgggttccggtgaagcccatcctcaagctgattaagtacacaaagccaaggactatgccaccagagctcgcttacatcaagaggcgggagttcatttcaaggaagaccgcgctcaaggctctggagtggatccgcagggacggctcattcacggatttctcccgcgagtacctcaggaagatcgagtccctgattaacggggacatcattgtcctgaagatcaaggatgttcgcaagaagcagtacaagggctacgtgtacgacatttcagttccaattacggaggctttcttcgggggcaacattccaatcctgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3279 - DNA, 4880 bp, Artificial Sequence
  Synthetic Construct, AT-122 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcataccataaggatttcaagattatgctcgctgacgggcgcaaggttcgcatcggggatctcgtggatgagctgatcggcaagaatagggagaaggttatcaagggcaaggacacagagattctgttcgtggacgatctcttcctcctgtcgtacaatatgcggtctggggagcaggttctggtgaaggctgatcgggtgagccgccacaaggctccagaccagttcatcaagctgcgcttctcgaacggcgctgagatcattgtcaccccggagcatcccgttctcatcattaacaatggcaagatcaagaccgttagggcggatacggtgcggaaggggaccctgacgatcggcgtgctcgggcacaagatcattaaggaggtcaacgaggacgatatcattaacaatatccgcaggaagattgtgctggacaaggagctcccgtacatccacgctaagaatatttcagaggccgtcgagatgcgggaccagctgatgtccatcgatattcccaccttcatcgttaagcataagaacgagattcgcctgtacccatccggcccttgcagcctcaggaggctcctgctcatgcacggggtcgaggaggtggtcttctcggacgagctgctctacgagatcatgaattgccatctctacccggccacctggtacgagctgctctactccatgggcctgacgaagatcgccaaggagctcaacgtgtacgacttcgagattctggcgggcatcattaagaaggtggagaaggaggtcatcatgctctctcaggtcctggggctccgcaacgagacacagactgagctgctccatctgaagtcaaggcgggagctgctcatcaggctcaaggacaagctggatatgctccgcaagaggctgaaggacctggaggaggccctcggcaaggatgccgtgatcaggatgattacagacgtcgaggttatcaagaacactgactccgattgggtctacgacattactattgagccttaccacctcttcgtttcggatgggctcattctgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3280 - DNA, 4862 bp, Artificial Sequence
  Synthetic Construct, AT-123 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctcgggaaggggacaccggttatgatgtacgatgggcggacaaagccagtggagaaggtggaggtcggggacaggctcatgggggacgatggcagcccaaggacggtgcagtcgctggccagggggagggagcagatgtactgggtccgccagaagaggggcatggactacagggttaacgagagccacatcctctcgctgaagaagtctaggagggagggcgcccgcgacagggggtcaatcgcggatatttccgtccgcgactacctggatcagtctgacaagtggaaggacgataacaagggcttcaaggtggctgctgagttcccagaccagccagtccccctcgatccttacttcctcggcctgtggctcggcgatgggaagtccgacaatgctaggatctacaccacggacgaggaggtcatcacgggcctgcaggagattgccgagaagcggggggacacaatttcagtgtccgatgagcatcggcgctgcccagcctacctcgtcaagtctggcgacaggggcggggctatggctaccagggagtcagttcagggcgctctgagggctctcggcgtgctgggggacaagcacatccctcatctgtacctcggcaactccagggggaagcggctcaggctcctggctggcctgattgacagcgatggccacctcaatgacgggcatggcgggacgtacgagatcacacagtccagcgagcagctggcgagggacattaagttcctctgcgatactctgggctaccggacatcgctcactcagaagaccgctcgcatctcgtctaccggctacgagtccgaggttcacagggtgcggttcaacgggaatgttgacgagattccggtgcgggtcgagcgcaagaaggcttccccatggactgatgtcagggactggcggatgaccggcatcgatgtcgagcccgacggcgttggggattacttcggcttcactctggatggcaatgggcgcttcctcctcggggatggcactgttactcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3281 - DNA, 4904 bp, Artificial Sequence
  Synthetic Construct, AT-124 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgatcctgagacagaggtcgtgacagtggacggcattaggcatgtggaggagattgaggtcggggatagggtttactcgctgaacccagacacgggcgctgtcgagatcaagcccgttaccgcgacgcagagccagcattacgctggcccgatggtggagattaagaaccagcataccgacttcctggtcacgcccaatcaccgcttcctcacacagaggttcacttcgggcgagtacacagatctggagtgggagactgctggcgacatgctcggggatcgcatccgcaggaggctcccatcactgaggtccctccctgctacacaggagaggccaggccctatctcactgtccgctgtgtgcgacaggctcgctatcgagcacaagactggcccacgcgggattaaggagctgaggaggcaggctaggtggcagcctgaggagtacgagctcacagattggctgaggatcctcggctggttcgccacagaggggactctgtacaagtctaaggcgaggcagtacgagaacggcaatgtgcggggggtctcataccagaccacgctctgccagaagaacgacatcggccgctccgagattgcgacgctcctgaacaggaccgggatcacgtactccagcgaccagaatgatcatagcttctgctcgaaggttctgtacgagattctggaggctgagtgcggcagcgactcgttctctaagcacctgccaccatggatcttccagctggggccaaaggacctcaagattgtcttcgataccctcatgcagggcgactccgctgctaacggggatcggttcacaacttcgtctaatcagctggccgaggacttcatcaggctcgctatgcacattggcaggagggctttccacatgccgaacgatgggtctcacaggatccaggttaataccgtgaggggccagcggccgacgattaagcccaagcatcggcagcaggtcgactacgatggcatgatccactgcctgaccgtggcggataatcatactgtgctcgctggcaggaataggaagttcaattggactgggcagacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3282 - DNA, 5117 bp, Artificial Sequence
  Synthetic Construct, AT-125 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatttcgggggatagcctcattagcctcgcctcaacgggcaagcgggtttcaatcaaggatctgctggatgagaaggatttcgagatctgggcgattaacgagcagaccatgaagctggagtctgctaaggtttcacgcgtgttctgcaccggcaagaagctggtgtacatcctcaagacgcggctggggcgcaccattaaggctacggccaaccacaggttcctcacgatcgacggctggaagcggctggatgagctgtcactcaaggagcatatcgccctcccaaggaagctggagtccagctcgctgcagctcatgtccgacgaggagctcggcctcctggggcacctgatcggcgatgggtgcaccctgcctaggcatgccatccagtacacgagcaacaagattgagctcgcggagaaggtggtcgagctggcgaaggctgtcttcggcgaccagatcaatccgaggatttcccaggagcggcagtggtaccaggtttacatcccggcgagctaccggctcacacacaacaagaagaatcccatcactaagtggctggagaacctcgacgtcttcggcctgcgcagctacgagaagttcgtgccgaatcaggtcttcgagcagccacagagggctatcgcgattttcctgcgccatctctggtcgacagacgggtgcgttaagctcatcgtggagaagtcttcacgccccgttgcttactacgccacttccagcgagaagctggctaaggacgtgcagtccctcctgctcaagctcggcatcaacgcgcgcctgtcaaagatttcccagaacggcaaggggagggataattaccacgtgacaatcactggccaggccgacctccagatcttcgtcgatcagattggggctgttgacaaggataagcaggcctccgtcgaggagatcaagacacacattgcgcagcatcaggctaacactaatagggacgtgatcccaaagcagatttggaagacatacgtcctgcctcagatccagattaagggcatcaccacgcgcgatctccagatgaggctgggcaacgcttactgcgggacggctctctacaagcacaatctgtcgcgcgagagggctgctaagatcgctaccattacgcagtctccggagatcgagaagctctcgcagtctgacatctactgggatagcatcgtgtcgattacagagactggcgtcgaggaggttttcgatctcactgttccagggccacataacttcgttgctaatgacatcatcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3283 - DNA, 5135 bp, Artificial Sequence
  Synthetic Construct, AT-126 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttctcgggggatactctcgtcgcgctgacagacgggcggtcggtttctttcgagcagctcgtggaggaggagaagcagggcaagcagaatttctgctacacaatccggcacgacggctcgattggggtggagaagatcattaatgctcgcaagacaaagactaacgccaaggttatcaaggtgacactcgacaacggcgagtctatcatttgcactcccgaccacaagttcatgctgagggatgggagctacaagtgcgccatggatctcacgctggacgattcgctcatgcctctgcatcgcaagatctcgaccacggaggactctggcatcaccattgatgggtacgagatggtgtggtccccgaggtccgacagctggctcttcacgcacctggtcgccgattggtacaaccggtggcagggcatctacattgcggaggagaagcagcattgccaccataaggacttcaataagcgcaacaataacccggataacctcatcaggctgtctcccgagaagcacctcgccctgcaccggaagcatatttcaaagacactccaccgcccagacgtggtcgagaagtgccgcaggatccatcagtcccctgagttccggcgcaagatgtcagcgaggatgcagtccccggagactcgggctatcctcagcaagcaggctcaggcccagtggcagaatgagacctacaagctgacgatgatggagtcgtggaggtctttctacgacagcaacgaggattacaggcagcagaatgctgagcagctcaacagggctcagcaggagtactgggctcaggctgagaacaggaccgctcaggctgagcgcgttaggcagcatttcgctcagaatccgggcctgcgccagcagtactcggagaacgcggtgaagcagtggaataaccccgagctcctgaagtggcggcagaagaagacaaaggagcagtggactccagagttccgcgagaagaggagggaggctctcgctcagacctactacaggaagacgctcgccgcgctgaagcaggtcgagatcgagaacgggtacctggacatttcagcctacgattcctaccgcatcagcaccaaggacaagtccctcctgcggttcgatcgcttctgcgagaggtacttcgagaatgacgagaacctcgcgcgcgaggctgtcctgaattacaaccacaggatcgtcaacattgaggcggtttccgagacgatcgacgtttacgacattgaggttccacatacgcataacttcgctctcgcttcaggggttttcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3284 - DNA, 5090 bp, Artificial Sequence
  Synthetic Construct, AT-127 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatttctatggactctatgattctgacaactgagggctacaagtcgctgcaggagattttcgagacacagggggttaaggtggacaacaaggagaaggttatcgagctgaagtacccgctcattaatcggtacggcgacgtggagtacacctcccacttcacgaagaacggggagaagccaacaaagcgcatcaagactaataagggcattgagctggttaacacatacaatcatcctctcctggtgagggaggggttcaacctgatctggaagaagagcgaggacatcgaagtgggcgatattctcgtgtcccgcgtgggcgaccaccagttcgggaacaataacactgtggagaacgaggaggaggcttacgctctgggctgcatggtcgcggattcttacctggggtcatactcccggctcagcttctcgaacgacaagaaggagatcctcgataaggtctcaaagttctggaacaccttctccaataaggaggtttactacgacacctacaaggagtccaaggggatcacgattcacctgcatgacacaaacaagactaaggagttccatgataagtacaagatcgagtacggcgtcgctaaggacaagaagatcccgaagtgcattatggagagccccgagaacatccagctggccttcgtctcgggctacctggagtgcgagtccagcatctctgagaagaacctggaggttacctctgcttcaaaggacctcctgaaggatctccagctgatcctctcgaacatcggcattgtgtctacgaataaggagaaggtggtcaagaagtacaagcacaacaagtactaccggctgatcgtcaatcgcaaggagctcattaagctcctgccgctcctgaggttcgagacgcagcagcggaagaaccagaaggagaatttcctcagcaataacacaaagatcaagtcgtcttacggcaacactattgaggggtcacgctacctcctgaagaagtacagggactccctgaatatcgataagaaggagttctccaagtacctcagccgggacaccatcacgattgatcgcctgagggaggtcatctcgctctacccggacggcgataaggagattcgcgagctgttcgagaacgttgtgaataacaatatctactaccagaaggtggagcaggtcctggagggcgagatcattcccaccttcgacgtttgcatgcctaagactcattccttcatcgccaacacaatcgtcaaccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3285 - DNA, 4910 bp, Artificial Sequence
  Synthetic Construct, AT-128 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgccatcctgcggacactaaggtcatcgtgaagggcaagggcatcgttaatatctcggacgtgaaggagggggactacattctcggcatcgacggctggcagcgggtcaagaaggtttggaagtaccactacgagggcaagctcatcaacattaatgggctgaagtgcacgccgaaccataaggttcccgtggtcacagagaatgacaggcagactcgcatcagggattccctcgccaagagcttcctgtcgggcaaggtcaaggggaagatcattaccacgaagctcttcgagaagatcgcggagttcgagaagaacaagccgtcggaggaggagatcctcaagggcgagctgtctgggatcattctggccgagggcaccctcctgaggaaggacatcgagtacttcgattccagccgggggaagaagcgcattagccaccagtaccgggtggagatcacgattggcgagaacgagaaggagctcctggagcggatcctctacattttcgacaagctgttcggcatccgcccatcggtgaagaagaagggggataccaacgcgctcaagatcacaactgctaagaaggccgtctacctgcagatcgaggagctcctgaagaatattgagtcactctacgcccctgcggttctgcgcggcttcttcgagagggacgctaccgtgaacaagatccgctctacgattgttgtgacccagggcacgaacaataagtggaagatcgacattgtcgcgaagctcctggattccctcggcatcccatacagccgctacgagtacaagtacattgagaatgggaaggagctcacaaagcatatcctggagattactggcagggatgggctcatcctgttccagacactcgtcggcttcatttcgtctgagaagaacgaggcgctggagaaggctatcgaggttagggagatgaaccggctcaagaacaattctttctacaatctgtcaaccttcgaggtgtcatccgagtactacaagggcgaggtctacgatctcactctggagggcaatccttactacttcgccaatggcatcctcacacataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3286 - DNA, 5444 bp, Artificial Sequence
  Synthetic Construct, AT-129 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctatcctgcctaacgagtggctgcccatcatcgagaacggggaggtgaagttcgtgaagatcggggagttcattgatcgctacatggaggagcagaaggacaaggtgcgcacagtcgataacactgaggttctggaggtggacaatatcttcgccttctccctgaacaaggagtctaagaagtcagagatcaagaaggtgaaggccctcattcgccacaagtacaagggcgaggcgtacgaggtcgagctcaactccggccgcaagatccacattacaagggggcattctctcttcactatcaggaacggcaagatcaaggagatttggggcgaggaggttaaggtcggggacctcatcattgttccgaagaaggtgaagctgaatgagaaggaggctgtgatcaacattccagagctgatctctaagctccctgacgaggatacagccgacgtggtcatgaccacgcccgtcaagggcaggaagaatttcttcaaggggatgctccggaccctgaagtggatcttcggcgaggagtcaaagcggattcgcacgttcaacaggtacctcttccatctggaggagctcggcttcgtgaagctcctgccgaggggctacgaggtcaccgactgggagggcctgaagaggtaccggcagctgtacgagaagctcgtgaagaatctgcgctacaacggcaataagcgggagtacctggttcgcttcaacgacatcaaggattcagtgtcctgcttcccccgcaaggagctggaggagtggaagatcggcacaaggaaggggttccgcaggaagtgcattctcaaggttgacgaggatttcggcaagttcctggggtactacgtctcggagggctacgctggggctcagaagaacaagactggcgggatgagctactcggtcaagctctacaacgagaatccaaacgttctgaaggacatgaagaatatcgcggagaagttcttcggcaaggtccgggttgggaagaactgcgtggatattcctaagaagatggcttacctcctggctaagagcctgtgcggcgtcaccgctgagaacaagaggatcccgtcgatcattttcgactccagcgagcccgtgaggtgggcgttcctcagggcttacttcgtcggcgacggggatattcacccatccaagcgcctcaggctgtccacgaagagcgagctcctggccaatcagctcgtcttcctcctgaactcactgggcgtttcgtctatcaagattggcttcgactccggggtctaccgggtttacatcaacgaggatctgcctttcctccagacctcccgccagaagaatacgtactacccgaacctcatccccaaggaggtgctggaggagattttcggccgcaagttccagaagaacatcacgttcgagaagttcaaggagctcgcggacagcgggaagctggataagaggaaggtgaagctcctggacttcctcctgaatggcgacatcgtcctcgatcgggtgaagaacgtcgagaagcgcgagtacgagggctacgtgtacgatctctcagtggaggataatgagaatttcctcgtgggcttcggcctgctctacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3287 - DNA, 9788 bp, Artificial Sequence
  Synthetic Construct, AT-130 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgcggcctacgatactctcgtgctgcagaaggacgggtcgctggttacgctggcggaggtttacaagcggcaggagattgagctgctcacactgggcaagaacagcaagttctacctcactaagccatcggccttcattgacgatggcatcaagcctattttccgcgtcaccacgaagctcgggaggttcgtggagacaactatcacccacccgttcctgaccgtgaacggctggaagcccctcagcaagctgcaggtcggggagaagattgccgtgccccgcaggctcaacattttcgggaatgagaccatctcggagtctaagttctccagcctgatcaacttcgacaatctctacctgttcccgctcgtgttccagctggagcggtcgcagctcgcgctgttcattcgctacctcttcagcctggatggctgggtgaagatctaccagaacaagatcgtctgcttcgggtactcaaccgtgtccgagaagctgatcaggcagattcagcacatcctcctgcggttcggcattgtctccgggatcgagaagttcgaggagaagcggacggagaagatcaaggtggtcaaggaggtgaagagccagcggtcgcaccgcgaggagttcacattcgctacttaccgcaactgctactgcgacggcaagtggcacctcaccattacggatgccctctcccagaagaacctgatggaggacatcggcgggttcgatagcaagaacttctacctgttcgacctcctgcagccgcacaacagcggcaatcaggagctggagaaccatctgatcttctgggatgagctcgttaatgtgctggcgaagttcgccgcgtctaagaaccagtcactcaagaatcgcaccgctaaggggaagtcccccaagaacagcgagaatctgaccacgacagagacgatttgcaggaagaacatcctcgccaacatggagaatctgccgagcgacaaccagaatttcgattcggagaagctcgacctgtctcagccccacaactcagggaaccaggagctggagaatcatctgatcttctgggacgagctcgtcaatgttctggccaagttcgcgacctcgaagaaccagtctctcaagaataggactaccaagcggaactcaccgaagaactccgagaatctgacgacaactgagaccatctgcaggaagaacattctggcgaacatggagaatctgccctctgataaccagaatttcgactcagagaagctcgatctgccgcagccccacaactccgggaatcaagaactggagaatcatctgatcttctgggacgaactcgtgaatgtcctggctaagttcgctgccagcaagaaccagtcgctcaagaatcgcaccacgaagaggaactctccaaagaactcagagaatctgacaactaccgagaccatttgccggaagaacattctggctaatatggagaatctgccttctgacaatcagaatttcgatagcgagaagctcgacctgccacagcctcataattccgggaatcaagagctggagaatcatctgatcttctgggacgaattagttaacgtgctggctaagttcgccacatccaagaaccagagcctcaagaaccggacgacaaagcgcaactcgccgaagaactctgagaatctgactaccacggagactatttgccgcaagaacattctggctaacatggagaatctgccatcggacaatcagaatttcgactctgagaagctcgatctgtcccagcctcacaacagcggcactcaggaactggagaaccatctgatcttctgggacgaactagtcaacgtcctcgccaagttcgcggcttcaaagaaccagtccctcaagaatcggacagcgaaggggaagagcccgaagaactcggagaatctgaccaccaccgagaccatctgccgcaagaacatcctcgcgaacatggaaaatctgccgtcagataatcagaatttcgattccgagaagctcgacctgtcgcagccccacaactctgggaatcaggaactggagaatcatctgatcttctgggacgaactggtgaacgtcctggcgaagttcgctacctctaagaaccagtccctgaagaataggacgacaaagcggaactccccgaagaacagcgaaaatctgaccactacggagaccatttgcaggaagaacattctcgcgaatatggagaatctgcccagcgataatcagaacttcgactcggagaagctggatctgcctcagccccacaactctggcaaccaagaactggagaaccatctgatcttctgggacgaacttgttaacgtgctggccaagttcgcgacatcgaagaaccaatccctgaaaaatcgcacaactaagaggaactcaccaaagaactccgaaaatctgactaccacagagactatttgccggaagaacatcctggccaatatggagaatctgccgtctgacaaccagaacttcgactccgagaagctggacctgccacagcctcacaacagcgggaatcaggagctggagaatcatctgatcttctgggacgaactagtaaacgttctggctaagttcgccactagcaagaaccaatccctcaagaatcggactaccaagcgcaactctccgaagaactcagaaaatctgaccaccactgagactatctgcaggaagaacatcctggcgaatatggaaaatctgccctccgataatcagaatttcgactccgagaagctcgatctgcctcagccgcataactctgggaatcaggagctggagaaccatctgatcttctgggacgaactagtgaatgtgctcgccaagttcgctacctccaagaaccaatccttaaagaataggaccacgaagcggaactcgccaaagaactctgaaaatctgaccacaaccgagaccatttgccgcaagaacatcctggccaacatggaaaatctgccttcggataatcagaacttcgattccgaaaaactggacctgccgcagccgcataattccgggaatcaggagctggagaaccatctgatcttctgggacgaactagttaatgtcctggccaagttcgcgacgtcaaagaaccagagcctgaagaatcgcacgacaaagaggaacagccctaagaactcggaaaatctgaccacaacggagacaatctgtaggaagaacattctggcaaatatggagaatctgccatcagacaatcagaacttcgacagcgagaagctcgatctgtcacagcctcacaactccggcacacaagaactggagaaccatctgatcttctgggacgaactagtaaatgttctcgccaagttcgcggcctctaagaaccaaagcctgaaaaatcggacaactaagcgcaactcccctaagaacagcgaaaatctgacaacgacagagacaatctgccgcaagaacattctcgcaaacatggaaaatctgccatctgataatcagaacttcgatagcgaaaaactggacctgccacagccacacaactccggcacgcaagaactggagaatcatctgatcttctgggacgaactagtaaacgtactggccaagttcgctgcgtcgaagaaccagtccttaaaaaaccgcaccactaagcggaactcacctaagaactccgaaaatctgaccacgactgagactatatgtaggaagaacatcttagccaacatggaaaatctgcccagcgacaatcaaaactttgactccgagaagctggatctgccgcagccgcataactccgggaatcaggagctggagaaccatctgatcttctgggacgaactagtaaacgtcctggctaagttcgccgctagcaagaaccagtccctgaaaaacaggactaccaagaggaactctcctaagaactcagaaaatctgactaccactgaaactatctgtcgcaagaacatcctggctaatatggaaaatctgccgtcggataaccagaacttcgattccgagaaactggacctgcctcagccgcacaattctggcaaccaagagctggagaaccatctgatcttctgggacgaactagtaaacgtgctcgccaagttcgccacctccaagaaccagtccctgaaaaataggaccacaaagcgcaactcgcctaagaactctgaaaatctgacaaccacggagacaatctgcaggaagaacatactcgcgaacatggagaatctgccttcggacaaccagaacttcgattcagagaagctggatctgccccagccgcataattccggcaaccaggaactggagaatcatctgatcttctgggacgaactagtaaacgtattagcgaagttcgctacctcaaagaaccaaagcctcaaaaataggacggccaaggggaagagccctaagaactcggagaatctgactaccactgagactatatgtcggaagaacatcctcgcaaacatggagaatctgcccagcgataaccagaatttcgattctgagaagctggacctgccgcagcctcataattctggtaaccaagagctggagaatcatctgatcttctgggacgaactagtaaacgtactagccaagttcgcgacctctaagaaccagagcctgaaaaaccgcaccaccaagcggaactccccaaagaacagcgaaaatctgactactaccgagacgatatgtcgcaagaacattctcgctaatatggaaaatctgccatcggacaaccaaaacttcgactccgaaaaactcgatctgccgcagccgcacaattccggtaaccaggagctggagaaccatctgatcttctgggacgaactagtaaacgtactcgctaagttcgccacttcgaagaaccagtcccttaaaaacaggaccaccaagaggaactcacccaagaactccgaaaatctgacgaccaccgaaaccatctgtaggaagaacatactggctaatatggaaaatctgccttctgacaaccagaatttcgacagtgaaaaactggacctgccccagccgcataactctggtaaccaagagctggagaatcatctgatcttctgggacgaactagtaaacgtacttgcgaagttcgctacaagcaagaaccagtccctcaaaaatcgcactgccaaggggaagtctccgaagaactcagagaatctgaccacgaccgagactatttgtaggaagaacatcctggccaacatggagaatctgcccagtgacaatcaaaactttgatagcgaaaaactggatctgccgcagccacacaactccgggaatcaggagctggagaaccacctgatcttctgggatgaactggttaacgttctcgcgaagttcgccacttccaagaaccagtccctcaaaaacaggaccactaagcgcaactcgccaaagaactctgagaatctgacgaccacagagacgatatgccgcaagaacattttagcgaatatggaaaatctgcccagcgacaatcagaactttgactccgaaaagctggacctgcctcagcctcataattctggaaaccaagaactggagaaccacctgatcttctgggacgaactagtaaacgtactagcaaagttcgccacctcaaagaaccagagcctgaaaaatcgcaccacaaagcggaacagcccaaagaactcggaaaatctgactactactgagacgatttgtcgcaagaacattttggcgaatatggagaatctgccaagcgataatcaaaacttcgattctgaaaaactcgatctgcctcagccacataattccggcacccaggagctggagaactccgacatcttctgggataagattgtgtccatcgagccggtcggggagaagcaggtgtacgatctcactgttccagagactcataacttcgttgctaatgatatttgcctccataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3288 - DNA, 5114 bp, Artificial Sequence
  Synthetic Construct, AT-131 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcggggtctacaaaggtcattgacgctgctacggggaatctcttctcgctcaaggagatcgccgctcagcctgagtactggctctcgcgcaaggtcttctctctcgacctgaagtcacagcaggtggtccagcagccaatcaccgagattcaccctaatggcgtgagggatgtctggcagatcaccacgaggaccaacaggaaggtgtgcgctacggacgatcatctcttctacacagtcctgggctggaagccgctcaaggacttcagcgttggcgatcgcctcgggctgccgaataagatccccattaactacaggtcccagatctccgacagcaaggtgaagttcacggcgtacctcattggcgaggggtacctgtacacaaattcgttctcttgctcatacttctgcaactccgacggggagctcatcgcggatttctacggctgcgctgaggagctgttcgggtccagcgctccaatcgagaagcagctccacctgggcaataagtccgtgatctacgtgcggatcggcctcatttccgggctgaagaactgggtcgactcctacctccagtgcgcgaatagccgcgtgcaggagatccccaactggattttctccctcagccagtcgcagctccagctgttcctcggcatcctgtggtctacgtcagggatcttcgacgagacaattggctacacttactactcgtctaacagcgaggtcctggttaggcaggtccagcatctgttcctccggctgggcatcgtttccctcttcaacgtcaataaggttaagggccagggggagctggacgtgtcctacgttgtggaggtccgcgggagggaggatatgctgaagttctacaagctcatcaagccgtacctgtcatcctacaagcagggcctctgcgagagctgctacctggtcattaagtaccagcagtcgtaccagttcaagtacttcctcactcccgacttcttcgatctgatcgtgaaggctaagaaggccagctcgatgaccagggctctcggcgtttgcggcggggagatctcttcagtgtggaacttccagaatacatctaaccggtccctgagcttcgacaagttcaacaatttctcgactgtcctcgcggatgaggagctgaccgccatcgcgaactcggacgtgttctgggatgagatcatttctatcgagtacattggcaaggaggaggtgttcgatctcactattccagagactcataacttcattgctaatgacttcatcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3289 - DNA, 4241 bp, Artificial Sequence
  Synthetic Construct, AT-132 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgacttacgagacagagattatgacagtggagtacgggccgctgcctatcgggaagatcgtggagtaccgcattgagtgcacggtgtacacagtcgacaagaacggctacatctacactcagccgattgcccagtggcacaatcgcggcatgcaggaggtctacgagtactccctggaggatgggaccgttatcagggcgacgccggagcataagttcatgaccgaggacggccagatgctgcccatcgatgagattttcgagcggaacctcgacctgaagtgcctcgggaccctggagatggttaagattgtgagccgcaagctcgctaagacggagaatgtgtacgatattggggttacaaaggatcacaacttcgtgctcgctaatgggctcattgcttccaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3290 - DNA, 5120 bp, Artificial Sequence
  Synthetic Construct, AT-133 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgacgggggatcagaaggtcctctactacatcgctaagaagctctactacgagacattcgctgagtgctacgaccgcattaacggcgacatctccagcgttagcgtgccatgcttcgatgagaactaccagacagtgattaagcctatctcggccatttggaagcaccatgtgaagaagaagggcttcaagattaagatcacttgggggaagcagattaagatcacagaggaccacagcctgttcactaggaacgagaacaataagccgcaggcggttttcggcaatgagatcaaggtcggcgatgagattgggatcccctcctacatctccttcctggagcagccgctggagcccttccatattaccgacaagattctcatccaggaggagatctacgtggagtcagaggacacgatctcctacattgagaagtacggcgataagatgcgggagtacctcctggcgaagtcgctgtctccgtcacagttctactccattctcaagacatacgaggctaagaaccagatcccgtggcacctgtggaagtacctggagctgcccctctccgagaaggacaaggtctgctacctcagcaagaaggccattaagaactggatcgataatgtcgaggagctcctgtggttcctgggcttctacgttgccaggggctcactgatcaagaacgaggtggtcctcaagggcgagccatcccagctggagaaggtcatcgagctcattgagaggatcttcgagtacaagagcgagatcaatgactcgggctacatttcgatcaagtctaagattctcgttgatctgatcggctacgggctcaacttcgggaatcaggagaaggacattccaaactggatcctgcagctccctgagcagcagctcatccggttcctgaagggcttcgtggctgggaacaacctggagaaccagctgaatttctacctggagttcaagacggactctcagctggtggcggagaagctggtcctcatcctgtcgaagttcggcctcgtcgctgacgtttctgagatcgaggttaacgaggaggatattgccaagatctaccgcatcattatcgagggcctggaggacaagaacatccataatctctctaaggtggagcagaagatttcagctctgaccacgggcgatatcgcttgggggaagattgagtccatcgaggagttcgagatcgacgattacgtctacgacttctctgttccaaactacgagaacttcatcgggggctcttacaatgttttcgctcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3291 - DNA, 4799 bp, Artificial Sequence
  Synthetic Construct, AT-134 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggatacgctgctgattacaagggactctattcataagattaaggatgtcgtggggcagaagattgagatttggaatggcaagaactggtctcaggtcatcccgctgaagacagggaaggacaggaagctctaccgggttcgcttcggcgacgggtcgtacctggatgttaccgagtaccaccgcttcttcgtgaaggacaggttcggcaagaagtacgaggaggtgcagaccaaggatctcctgacgcactccaagtacgccctggacgtcgagccattcatcattgattaccatgacggcgattcgatcaacctctcttacgcttacacactgggggctgctctcggcaatgggactatcgaccagaactctaatggcaagattagggtgtactcacataaggccgagctgatcttcgcgggcaacaagtccctggagcggcagtacaattacctcccgagcttcgtggacgtcattgatctcggcttctcgggggagctcctgaggaggctgcagaccgagcccgacgctctcaacacgatcgcctcatggaataagtccgctatcctggccttcattgcgggcctcgctgacacagatgggagcgagactaagggcaacgggatcaagatttccgtgagcgactacgagagggccaagcggctgcagctcctgctcacgaagtgcggcattagggcgagcgtcaatctgatggcttcgcggggctgcaccacgaacctcggggagcgcaatcaggacctgtactacctccagatcaccgattgccgggagattccatgccagcgcctcgacacaactaaggtttgcgaggcgaagttccagggcaagtaccagaccatccagaacgtcgaggagctgcctggcctccacgatacgtactgcttcgaggagccagagttccacaagggggttttcggcaatgctctcacaggcaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3292 - DNA, 4973 bp, Artificial Sequence
  Synthetic Construct, AT-135 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggacaagacggctctgcggattttcaatcaggggctgctctacgcggatgaggtcgtgacaccgggctcgggggagacagtcggcctcgggctgacggtcaggaacggcatcggggcgtccacagccattgcgaatcagccgatggagctggttgagatcaagctcgctaacggccggaagctgcgcatgacccctaatcaccggatgtccgtgaagggcaagtggattcatgcctgcaacctcaagccggggatgctcctggactacagcatcggcgagtaccagaagcgcgaggacaccctcctgattcctctccagctggaggattacactgaggtgaacaattcgcagaccctgggccacaacggcggggtcctcaccaagaagatcatgacgccggcgtcaatgacatccgacctggcttacttcctcggctgcctgttcggcaacgggtgcatcgtccagaataagtaccaggtttgcttctaccattctcggctcgacgtgctgtacggcctccaggagaaggggaagaagctgttcggcatcaaggggtctctcaacgatttcgccaatggcaggttcgagctgtgcttcgcgtcacggcagctcttctactggctccacctgaaccagctggtcaagacgcagaagtcagaggacctggagcgcatccccctctccctgaggaggtccagcagggttactctcctgtccttcttctgcggcctgattgacaccaacggctacgtgccacaggatggcaagctcagcatcgcttcggcctcgtctgatttcattcataacctgcagcagatcggcgagtccattgggctctgcttcagcatctaccagaatacgaagggggagaacctgcagaatcagcacaacaatacatggggcctctgcctgtctcccatgctctcaaacgtggacgcgctggattacctcaaccataatagcatcaagtgccaggagggcccggtggtcatttcgaagtgcgtcctcaactactcgccctacaagatcgagtctgttaatattggcgctgtgtgcgactacagctacgatttcgccatcgagggcatcaatgataatgactcttggtactggcagggggctctcaagtctcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3293 - DNA, 5237 bp, Artificial Sequence
  Synthetic Construct, AT-136 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtgctgcatgacactgagatctacgtgaatggcatggttatggaggcggagcagatttggcaggcttacgcgggggaggcggagttcgacggcgaggggttctggacagagccgaacaaggagctcctggttaatagcctcgatgagaccacgggcaagatcgtgttcgcccggattcgcaggctgtaccgccagtgggttagggagaagctcaggaaggtgcggctgaaggacggctccagcatcacaattacttgcaggcacaagctcttcatccgggactcctggaagaacgatttccaagtgggcgacgatgtctgcgttcccgcgaagctgatgtgggacgggaagccagaggacccagatgtggtcaagttcgtcgcttggcaggttgctgagggctgggagagggtcaattccggcatgttcggggttagccagaagggcaaggacgtgctggaggggctcctggaggtcttctcgcggctgggcaagcgctacgatatcaagattaactgcccaaaggttgtggcgcacgggtctaagaagaattgctacgagttcagcgctcattcgctggagtacaggaagttcctggaggagaagcgctacggctgggggaagaggtcccatgagaagaccatccctctgttcattatgcaggccgacctcgattcggtgcgggtcttcctgtctaactacttcgacgcggagggctgggtgaataagaccgttcgctgcgtggagatctccacggcctcgtctcagctcatccaggagctgagcattctcctgcggcgcttcggcgtctggatgaagatctcaccgcagcagaagtgcgctaccaacggcacgggggttttctgcacatactacatcgggactttcggcgggaatagcgccaggtgcttcctccaggagatcggcttcaacgacagcgggaagcaggagaatctgaagtcgatctgcgagaagattgcggactctaacgtggagggcatcccggcttcagatattgtggccgagctcgtcgagaagacccagctcccagtcggcagcctggggatccaggaccctatctacatggacggctgccaggatttctctcccacgtcactggagaaggtcatcaactcaattgaggatatcatttccggcgctggggaggaggagtacggccagctcaagtcatccaagctgaggaacaagacactggaggcttactcgctcctgaatatcctggagctggagatctacaagactcggctccagaagctcctgaaccaggaggtgtactactgccagatcgagtccattgaggagatggagtacgagggctgggtctacgacttcgaggtttccaagtaccacaatttcgttgctaacaacatcatttgccacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3294 - DNA, 4997 bp, Artificial Sequence
  Synthetic Construct, AT-137 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcggttacgggggatactgaggttactattaggcggaatgggcggattgagttcgtccctattgagaagctgttcgagcgggtggatcaccgggtgggggagaaggagtactgcgtgctcggcggggtcgaggctctcacactggacaacaggggcaggctggtctggaagaaggtcccatacgttatgaggcacaagactgataagaggatctaccgggtgtggttcacaaactcctggtacctcgacgtcactgaggatcattcactcatcggctacctgaatacctccaaggttaagccagggaagccactcaaggagaggctggtggaggtcaagccagaggagctcggcgggaaggtcaagtccctgatcaccccaaaccgccctatcgccaggacgattaaggccaatcctatcgcggttaagctctgggagctgattggcctcctggtgggcgacgggaactggggcgggcagagcaattgggcgaagtactacgtgggcctctcgtgcgggctggataaggctgagatcgagcgcaaggtcctcaacccgctgagggaggcctcggttatttctaattactacgacaagtccaagaagggcgatgtctcaatcctctccaagtggctggcggggttcatggttaagtacttcaaggacgagaacggcaataaggctatcccgtctttcatgttcaacctcccccgggagtacattgaggctttcctcaggggcctgttctccgctgacgggaccgtgagcctgaggaggggcatcccggagattaggctcacgtcggttaaccgggagctgtctgatgcggtgcgcaagctcctgtggctcgttggcgtgtccaacagcctgttcaccgagacgaagcccaatcgctacctggagaaggagagcggcacccactcgatccatgtcaggattaagaacaagcaccggttcgccgaccgcatcggcttcctgattgataggaagtctacaaagctctcagagaacctgggcgggcatactaataagaagagggcgtacaagtacgacttcgatctggtgtacccgcggaagatcgaggagattacgtacgacggctacgtctacgatattgaggttgagggcacacataggttcttcgctaatggcattctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3295 - DNA, 5096 bp, Artificial Sequence
  Synthetic Construct, AT-138 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgaccgctgatacttacgtttggacagatcgggggctggagacagtcgctgaggttttcgggcgggcggggctccctctctcatccactagcagggttaccgacgtgagggaccgggatatccgggtggtcaacgagaagggcgagctggagcaggtggctgctctcacgcataatgggaggcagccagttgtgaggatcacagtcgcttccggcaggcaggtcacggttacacggaaccaccctctgcgcgtcatgaatgacgatggcttcattgtttggagggaggctgggcagctgagggagggcgacgtgctcgtctccgctgccttcggcgctgtccaggctgcttcgggcgggggcctctctgaggacgaggctgttctcctggggtacctgaccgctgctggcagcctcgatccagctgggcatgtgtgcttcaccacgacagacatcgagacaggcgctgagttcgctgctctggctgagtggctcctggacactaccgtcactgctgttccaggggatggccaggtggcctacgtgctgtccgacccagctgctaggcacacgctcgctgagcgctacggcgtggattacgctgctgctgctcggatcccgcagtgcgtccgcactgctggcgacaagatgcagagggctttcctcgctgctctgtacaccgctgctggctggactgacaccagcgctgccgttgggctgaggacggcttcggctccactcgcgagggaggtgcagtacctcctgtacgggctgggcatcccagccgacctcgataggtctcacgggaacggccagcatccttgggctgtgaccatttcaccagctgctgctccaaggttccacactgaggtcggcttccgcaccgctcagcagtcgccacagacggggctgcatgagccaacaccacaggtggaggctatcccaaatctcacgggcctgattcacgctctcagggactcaatcggggatcgggccgagtccacagacgatccattccctgctgctagcgggggcgcttacgacagggatcaggttcgccgcgtgatcgactgggctaagaggaggactgatgaggctccagctaccgctaacgctatcctcggctacctgacgcagctcacagatgccaggtacacgtacgagccaattacagccgtcgaggacgcgggccagcagcctaccttcgacctcatggttccaaggactcatagcttcctcgccaatggcattctctcacacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3296 - DNA, 4901 bp, Artificial Sequence
  Synthetic Construct, AT-139 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatgcactacgacacactcgtgacactcgctgacggcacacaggagaagatcgggacaatcgtggaccgcaagctggacgtggaggtcctgtcgtacgatccagagaccgacaggatcgtgccaaggagggtggtcaactggttcgataatggcgccgcggaccacttcctgcagttcactgtgggcaggtctgggaagccaggcggggctcagttcaccgctacgccaaaccatctcatcaggacccctggcgggtggagggaggctggcgagctcattgctggggacagggttctggtgcacgagccacattacctcaatgagcagcagaggcaggttgtgtacggctcgctcatgggcagggggacgctggtcccagataggcacggcgggcctggcgttcacttctgcatggctcatacagccgagcaggctgcctacctggactggaaggtctccctcctgggcaacattgcccactcacgcaccgctgaggcttccgctacggtcggggttgagttcacaccgatgcccgagctcagcgagctgcatagggtcgttgatttcggcgacgggcacacccatctcacgtgggagttcctcaagcagctgacgccactcgcgctggctgtgtggtacctcgatgcgggcacactgactatccctcagtccgggactgacgatgacgccagggtgcagattgacgtcgagaccctgtcgccaggctctcggcagaggctcgtcgagtacctgagggatacccacgagctcgacgctgctgtggtccagcagggcgctgacgcgaggtctctcctggagttcacaccagctgctaccgtgcgcttcctggagctggttgcgccatacgtgcctgagtcaatgtccagcatgctcctggctcagttcaggggcaggtgcagcgtcacgccagagtactcggatccagtccagaggctcgttgctgctccagtgctggacatccaggtgaagcccggcagcacacgcaagttcgacattgaggttgagggcaatcataactacttcgtggatggggtcatggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3297 - DNA, 5441 bp, Artificial Sequence
  Synthetic Construct, AT-140 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcgctgctgcctgaggagtggattccgctcgtggagaatggcaaggttcggctgcatcgcatcggggagttcgtggacaagctcatggagaccgacagcgagctcgtcaagcgcaacggcgataccgaggtcctggaggtgcgcgggatcagggctctgtctttcgaccggaagtcaaagaaggcgcgcgtgatgccggtcaaggctgttattcggcaccgctactccggcgatgtgtacgagatcgtcctcggcagcgggaggaggattaccgtcacggaggggcattcgctcttcgcttacggcgacggggagctgagggaggtgacaggcggggagatcaaggctggcgatctcctggctgttccaaggagggtgaacctgcccgagaagaaggagcgcctgaatctcgtcgagctcctgaggaggctcccagaggaggagacaggcgacatcattctgactatccccgtgaagggcaggaagaacttcttcaaggggatgctgcggacactccgctggatttccggcgaggagaagaggccaaggactgctaggaggtacctggagcacctggagggcctgggctacgtgcgcctcaagaagatcggctacgaggttaccgacagggaggggctggagaggtacaggaagctctacgagaggctggtggaggcggtccggtacaacggcaataagcgcgagtacctcgtggagttcaacgctgttcgcgacgtgatcgccctgatgccggaggaggagctcagggattggctggtcggcaccaggaatgggttccggatgaggcccttcgtggagatcgaggaggacttcgctaagctcctgggctactacgtctcggaggggaacgccaggaagtggcggaaccagaagaatggctggtcttacacggtgaagctctacaacgagaatcagcgcgtcctcgacgatatggagtccctggcggagaggttcttcggccgcgtgaagagggggaagaactacatcgagattccaaggaagatggcttacatcattttcgagaacctctgcggcaccctggccgagaataagcgggttccagaggcgatcttcacgtcgcctgagtctgtgcgctgggccttcatcgagggctacttcattggcgacggggatgttcatccttctaagagggtgcggctgtcaacgaagtccgagctcctggtcaacggcctcgttctcctgctcaatagcctgggggtctcggccatcaagattcgccacgactcaggcgtttacagggtttacgtgaacgaggagctcccattcacagattaccgcaagaagaagaacgcgtactactcccatgtcatccctaaggagattctggaggagactttcggcaaggtgttccagcggtccgtcagctacgagaagttccgcgagctcgtgaagtccgagaagctggacggcgagaaggccaagaggatcgagtggctgctcaacggggacgtggtcctcgataaggtcctggaggttaagaagcggccatacgagggctacgtgtacgatctctctgtggaggaggatgagaacttcctcgctggcttcgggctgctctacgctcacaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3298 - DNA, 4835 bp, Artificial Sequence
  Synthetic Construct, AT-141 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctcctaccatcatgatttcgagctgctgctggctgacgggcgcaaggttaagatcggggagctggtggacaagctgattgagaagaatcgggaccgcgtcatcctgggcaaggataccgagatcctcccggttgaggacattgagctcctggcctacgatctggagaagagggagatcgttaaggtgaaggctgaccgcgtctcaaggcacaaggctccagagcgcttcatcaagctcaggttctccaatggccgggagattaccgtgacgccggagcatcccgtcatggtttgggagaacggggagatcacagagaagccagcggagaagatcactcctggcgatattgctctcggggttctgcgctacccgattcaggtggacggcaagttcaaggagaggtaccgggatatgagggaggcggaggactaccaggattacctgtactcccggggcgtggtcagcaagatcaagcgcaccgggatctacttcacggtggagaaggctaggagggctctcccgcgggagctggtcaagcccctcatcaacgctggcaagattctcagggttacacagactccaaaggagcgggcgagcttcaatcagaagctggtccgcgagaacatcattgaggggtacctccagaggatcattgagcggatggacgagctggagaggctgtcgcgcgaggatccagctaaggctctggagctcctgcctaagacccagctctactacaagtacggcatcacgtacgggaagctcaagaagctggctgaggctcgcaactcctgggctgagggcatcattcagtcggcggtggctgagcgcatctctctggccaagagggagctggaggagttcttcaagtggtggaacgcgaatgtcaacttcctgaaggtgaagtgcgtcgaggagatcaagaacgaccgctgggagtgggtgtacgacgttactgtggagcctcatcatctcttcgtttcgcatgggctcgttctgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3299 - DNA, 5039 bp, Artificial Sequence
  Synthetic Construct, AT-142 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatgcatcctgacacatacgtggttactaagtcgggggctaagaaggtctctgagctgactgagggggatgaggtcctgacacataccggcacgttcaagaaggtcatccagccactgaggagggagcacaaggggcgcctcctggttatcaaggcctacggcaccgtgcctgtcaagattacgccggagcacatggtttgggtggtcaagcagatcaggcacaagtcccattacagcgatgggcggcaggtcatttggtgggagttcgagggcccagagtggatgacggctcaggagctgaaggagcgcctggagtccgagacagacccaaaggtgagctacatgctcctgcagccaatccctgagccgtccgtggacgcggataagattcctctgaggaaggaggtctacgttgtgaaccagcacggcaagacagacaagctccatccgtccgtgaagcggactcccgagtacctgccactcaacttcgagaccgctaggctgatcggcctctggattgctgaggggtcaacttccaagaacggcgtcatcaagttcgacatttccagcaatgaggaggatctgacggagttcatcacaggcactattaggaagtacttcccgcacgctaagatcgtcgttaaggaccatgagaggaacaggaggacggtccggttctgcaataagcgcttcgcggagtggctcagggagaacatcggccacggggctgataataagagcattccgcccctcctgctcctgaacaagaatagggaggtgcgcctgggcctcctgagggggctcatcgagggcgacggctacgtgcgcagggagtcgcagcgcagggcgaactacatcagctactcgacagtttctccctcactggcttaccagctccagctcctggtggcttcgctgggctacacctcgtctatccacaggtctattcggacagagggcatcgggaagactaggaagcccatctacgatgttaaggtgtcgggcaagtcttactactcactcctggaggagctcgggttcgaggtcccacagaggggcaacaggacctacaacgttaatcgcacgtggaagaattacctcctgctcaaggtgaggtccatcgaggaggaggagtacgagggcgacgtttacaatctggaggttgagggggatgagtcaggctctgtgggcttcatcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3300 - DNA, 5468 bp, Artificial Sequence
  Synthetic Construct, AT-143 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgctgccggatgagaaggttattctccctgagcatgggcctattacactcaaggggctcttcgatctcgctaaggagacagtcgtggctgacaacgagaaggagatccgcaagctgggcgccaagctcaccattgtgggcgaggatgggaggctcagggtcctggagagcccatacgtttggaaggtgcggcaccgcggcaagatgctgagggtcaagctcaagaactggcactcagtgtccgtcacgccagagcatcccttcctgaccacgcggggctgggtgcgcgctgaccagctcaagccgggggattacgttgcggtgcccagggtcatccatggcaacgagtcagacgagcggttcgtctccttcgtttacgagaagctcaagaatgatgagctgatcgcgaagctccgcggcgaggtgctgtccaagatttccagcgagttcaagggggacagggcttacaaggttgagaggaacgtgttccggtgggaggacatcgagcgcctcaatctgtgggatgaggtggagagggtcgccttcaccccaaggatgcacaggagcggcaagccactgcattacgtgaagctcccaaggtcgcctgaggagtgggaggctttcttctacttcgctggcgtcatgttcggcgacgggtcccaggataagatcgccaacaatgacgtcgaggtttacgaggagctcaagaagctgtctgttctcggcgtggctgtcaagagggtggagaggacaacttcatacgagatcgagctcaccaacgggaagaatgctctcctgaggctcctgagggtgctgttcgagtacccggagcggcagaaggcgaagtccattagggttccacggatcctgttcattgctcctcgcaagtatgtgtcccgcttcctcaggggctacttcgacgcggatgggcacgtcagcctgaaggacgcgaggatcgaggttacgagcgcttcgcaggagttcctggaggatctcagcctcctgctcctgcggttcggcatcgtgtccaagatctaccgcagcgactacaccacgctcgttatctcgggccgcaggaacctcgatctgttccggcgctacattgggttctctgtcaagaataaggccgaggcgctggagaaggccatcaagaagtcaaggcggtctgagtcataccccattttcgaggagctgaagaggctccggctcctgttcggcttcacacgcactgagctcaacagcaatgtgccattctacgggaagtacgagtcggaggaggccccttcttacgagacactgatgaggatcctcgacgcgattgagaagggctcgatcaacctggataagaagattgctgtcctggaggggcgcatcagggaccataattacattaaggccttcgagaaggacggcctgatcaaggatgggaagctgactgagctcggcagggagctcctggaggtctggaggaacagggagttcgactcgtctgacgtcgattacatccggaacctggcggagaatctcgtcttcatcccggttgaggacattgaggagttcgagtacgagggctacgtttacgacgttactacagagactcataatttcgttgctaatggcatcctcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3301 - DNA, 5405 bp, Artificial Sequence
  Synthetic Construct, AT-144 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggactcaaagatcctgacagggaaggggccagtggagatcgggcggctgaactctaacatgatcgcgggcatttggcgcttccagaccgagctggtgcggttcgaggagccacaccgcgttgagtaccgcagggagggcgtgaagatccgcacgaggctcgggttcgagattaaggccaccaaggagcataagttcctcacggtggacgagaacggcgagctgcgctgggtcgaggcttggaagctcaaggagggcaactgggtcggggtggtccggcgcctgccatctcctaatgtgaaggtctcaatcctcgacctcctgccgcccaacgcctacctcaagctgaagggcgagttcctgagggagctcaagctgtcgatccaggcgaagttcggctctattaggacatacgccaagaagaagcgctggtcagagtcctacctcgtcaagcagctgaatggcgtttacccgttcaggtgggagaggctctccgctgtgctgaaggacctcgatctgcgcatgacagagaacgacgtcgagaggatcacttccgataagggcaagtacagcctcccgatcgagttcaccccctcaatggctaggctcctgggcttctggatggctgacgggtcctggaagggcgggaccctcacgctgttctccagcgataggaagatgctggagaagtacaaggagctgtgcaaggaggagttcggcgttgtggggcggatccgcatgctcaacgagtctacatactcactggagatctctttcaatctcctgccggctattttcaagaacctgacaggcaatactgagcgcaagagcaagctcgggactttcccatccatcatctacagcctgcctgaggagcacaagagggagttcctcgcgggctacttcgacggcgatgggttcctggaggttaagggcgggagggtgtactcggctggcttctctaccttcaacaagaggttcgcggagggcatccgggacattctcctgcagctcgggatcgtgtcgtctattagggcccgggagtacgatgaggtccagaagttcaagggccgcgttatccccaagaagggggcttcatacacggtttccgtgctcggcggggagtacctgaagaggttcttcgacgccgtccgcccatggaggtcggattacgagggctgggaggggatgtacaacgagggctacagcaattcggacgtcgttcccaacctcggcaagcgcctgaggagcatcagggagaggctgggcattagcgcttaccgcatgtcgaagatggggttctacaatccagtccgcgttgagctgggcgagagggagatctccaggcggaacctcaggctcctggtggagttctacgagcgggtcgcgaaggagaagcgcgtggaggacgtcctggaggagctgagctacctcagggagctggctgagggcgacgtgttcttcgatcgcatcacgtcggtggagcctgcctacattgatgtcgcgtacggcatcatcaactcggagacagagaactacatcgtggagggcttcatttccaagaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3302 - DNA, 5438 bp, Artificial Sequence
  Synthetic Construct, AT-145 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctctattctgcctgaggagtggctgcctgttctggaggagggggaggttcatttcgttaggatcggggagctgattgaccgcatgatggaggagaacgctggcaaggtcaagagggagggggagaccgaggtcctggaggtttcaggcctggaggtgccgtccttcaaccgcaggacgaataaggcggagctgaagagggtcaaggctctcatccggcacgactactctggcaaggtgtacaccattaggctgaagtcaggccggcgcatcaagattacgtcagggcattccctgttcagcgtccggaacggcgagctcgttgaggtgaccggcgacgagctgaagccaggggatctcgtcgctgttccaaggaggctggagctgccagagaggaaccacgtcctcaatctggttgagctcctgctcggcacaccggaggaggagactctggacatcgtgatgacgattcccgtcaagggcaagaagaacttcttcaaggggatgctcaggacactgcggtggatcttcggcgaggagaagaggccaaggactgctcgcaggtacctcaggcatctggaggacctcggctacgtgcggctcaagaagatcgggtacgaggtcctggactgggatagcctcaagaattaccggcgcctgtacgaggctctcgtggagaacgtccgctacaacggcaataagagggagtacctggttgagttcaattcgatccgcgacgccgtggggattatgccgctgaaggagctcaaggagtggaagatcggcacactcaacgggttccggatgcgcaagctgattgaggtcgatgagtccctcgccaagctgctcggctactacgtgagcgaggggtacgcgcgcaagcagaggaacccgaagaatggctggtcgtactctgtcaagctgtacaatgaggaccccgaggttctggacgatatggagcggctcgcgagccgcttcttcggcaaggttaggcgggggaggaactacgtggagatccccaagaagattggctacctgctcttcgagaatatgtgcggggtgctcgctgagaacaagcgcatcccagagttcgtcttcacatcacctaagggcgttaggctggccttcctggaggggtactccagcgctatggctacctccacggagcaggagactcaggcgctgaacgagaagcgcgctctggccaatcagctcgttctgctcctgaactcggtgggcgtctctgctgtgaagctcggccacgactccggggtttacagggtgtacatcaatgaggagctgccattcgtcaagctcgataagaagaagaacgcttactacagccatgtgattcctaaggaggtcctctcggaggtcttcggcaaggttttccagaagaacgtgtccccacagaccttccggaagatggtcgaggacggcaggctggatcctgagaaggctcagaggctgtcgtggctcatcgagggggacgtggtcctcgatcgcgtcgagtctgttgacgtggaggactacgatggctacgtgtacgatctctctgtggaggataatgagaacttcctcgtgggcttcgggctcgtttacgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3303 - DNA, 5276 bp, Artificial Sequence
  Synthetic Construct, AT-146 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3304 - DNA, 5297 bp, Artificial Sequence
  Synthetic Construct, AT-147 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttacccctgacacactcgtttcgctcgctgacgggcggattatggagatcaaggatgcggtggagaagtcggagggcaatctgctcagcgtgaacggcctgaagccgaaggaggccaaggcgctcaagttctgggagatcgactggaacgggcccctcaaggtcatcaagctgaagaatggccacgagattaaggccacgccagaccatgggctcctggtcatgagggagggcaagctggggtgggtttcggcgaagaacgtgagggagggcgactacgtcgctttcgcttacaataccggccacagggggagggatgagtacacgctcctgaagctcatgatcaagctgggcattaccgacgtgatggtcgagctcgatgaggagtacttcaacgagaaggttgcccctatcgtgagggagcggatttccacaagcactaagtacaagtacctgaggaggagggtcctcccactgtacctcctgcaggagtggggcctggacgattacgaggcccatgttaagtccctctacaggcagagggctggcagcaagccaatccccaatttcaagctcgacggcaggttctggtatgtgttcgggctcgttctgggcgacgggacactccgcgatagcaaggtgctgatctcgcagactccactcaaggacgtcaagtccgttctggaggatgtcttccctttcctcagggttttcgagaccacgaaccaggttggcttctccaactccatcatcgctgaggtgttccgcaggctcggcgctaggaaggggaagctccacccactggtcttcggcctgagggaggagtacatcaacgcgatgattgctggctacttcgacaccgatgggacgttctctatcctcaacgacaggaagggcccaaatttccgggggatcctgacatcaaagcggggcgatgtgctccgcatgctgtccgtctacctgtaccagatcggcattatgaactacctcaggagggacgagaggaccggggtgtgggatctgatcatttcaaatcgctccctggagaagttcagggagaagatctacccgtacctccggattaggcgggctcagttcgacgaggcctactctgtctacagggcctcacgcagggctttcgagggcgatctcctgccagtggcccctgtcttcggcaagctgaagttcaagaacgggacaaagaatcgcatcctcaaggagactggcattgacgtgtggaactggctgaagaggccagagggggagatcccccgcgataagctctccaaggtcctggagtacgctgaggagtcgcccgagaaggagttcctcaagtctctggtggaggcgggcgtcacctgggttaaggtgaagggggtggaggaggagctgtacacgggcaagctctacgacttcacaactactacggagaatttcctctcaaatggggctgtttctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3305 - DNA, 5192 bp, Artificial Sequence
  Synthetic Construct, AT-148 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcatcgatggcaacgctaagattattttcgagaatgacggggaggagcatattatgacaatggcggagatgtacgagcgctacaaggatctgggcgagttctacgacccggagtacaaccggtgggggatcaatgtggaggaggttccggtctacgtgaagtcattcgatccctccaccaaggagattacgaagggcaaggtgaaggtcatctggaagtacgagctcggggaggacgttcccaagtacgagatcaagacaaacaagggcactagggtcctcacctcgccatggcaccctttcttcgtcattacgcaggatctgaagatcgttgagaagcgggctgatgagctcagggagggcgacatgctggtcggcgggatgccatctgacgatgactacgagttcctcctggactactggctcgccggcttcattgcgggcgatgggagcatcgacaagtaccgctcgcacgttaagggccatgagtatgtgtacgatcggctgcgcatctacgactacaccacggagacgctcggcatcattaacgaccacctggagaagacattcgggaagaggtactccctccagagggatcggaatatccactacatcgacattaaggccaagggcattactagccattacatcgagctcctgcgcggcatcaccaacgggattccgcagcccatcctgaaggagggcaggaatgctgtgctctctttcatcacgggcctgttcgatgccgaggggcatgtcaactcaaagccaggcgtggagctcgggatggtcaataggaagctgatcgaggacattacatactacctcaacagcctgggcatcaaggcgcgcatgaggaagaagcctcggaaggatggggtggactacgtcatgcacgttgaggagtactccagcctcctgcggttctacgagctcattggcaagaacctgcagaactccgagaagcgcatcaagctggaggagctcctgtctaagcataacggcgggtcattcggcctcaccctgtccttcgaggacttcaaggcgtggtcgtctaagtacggcgtggagttcaagacgaacgggtcccagacactcgctatcattaagaatgagaaggtgagcctgggccagtggcacaggagggggagggtctcgaaggctgtcctcgttaagatgctccggaagctgtacgatacaactaagtccgaggacgtgaagcgcatgctccatctgattgagggcctggaggtggtcaaggagatcaacgtcactaatgagccaaagaccttctacgacctgactgtggagcgctaccagaactacctcgccggggagaatggcatggttttcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3306 - DNA, 5363 bp, Artificial Sequence
  Synthetic Construct, AT-149 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcatccggactcactcattcctacgcctcagggggttaagcgcatcaaggagctgccggagaagggggaggtcttcgctctcgacttcgatctcaagctgtcacgggcgaggtacaggctcctggagagggacgctgatgagcccatgtacaaggtgacactctccgacaggactgagctctacctgaccgcggatcacccggtcctcgtttacagggacgatcagctgatcttcgtccccgctgaggagctccgggagaacgaccaggtggtcctgttcattaatcgctcagagtactccccaaggaccgagtcgcctacgctcctgggcttcctcctggagaacgccacctctatgaaggactacatcctctacgatccagagttcggcggggtgctgaggaatcgcattaaggacgcgggcctcaagactgagatcctgtggaggttccggattcgcgagcccacctactacaagtacctccgcggcaagatgccggttcccatcgtgaggttcctcctggaggagggcgttgtgagcattgaggagctccgggaggtgttccgcgggttctcgtactctacatcactgactccaatcagcttcgagttctcggaggagttctggtacctcttcggcctggtcgctggcgacgggcacctggctaagaagggggctatcaccattccagccaaggaccgcaccgaggatacggtcaaggcggttaaggagatcgctaactccctccaggtgcctttcgccttcgacgagaagtacaagatgatcattctgcggtccaagagcctcacgaggctgttcgagctcctgggctgcccgtacgggaacaagacagagatcttcaggattccgggcgagatcatggcgaagccagagtggatggctgcgttcctcgctggctactacgacgcggatggccacatcgggacaaagccaactggcgggaagaagtcgcattctcctcagatcgtcctgacgagcaagaaccgcatggccatctacacagtcaagcagatgtggcagctcctgggcgttgggacgtacctctgggagaagaaggacaggaacggcaatttcatggcctacgagctgaaggtgtactcccgcgacgcgtggcggttctacgaggtcatgaagaaccacctccgcatcaagaggaaggacctggagcatgtgaaggaggtcgctattaggaagcggaaggcctactctcaccattactcagttctcaatgtgaagtcttgggagggcaagatcaagtccagcaacgttctgtggaagaagttcgacatgtccaatcagaccgctcacggcagggggatcagcctcgacaagctgcagcgcattgtcgattacctcaccgacacggatctgcgcaggatcgcgatgggcgatgtctacgtgctggggatcaggtccattgagaagttccattaccggggcaaggtgtacgatctcgtcgtggatcagtaccacaacttcattgctaatggggtcgtcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3307 - DNA, 5099 bp, Artificial Sequence
  Synthetic Construct, AT-150 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcctgcgcgggctagggtcgtggattggtgcacagggcgggtcgttcgggtcggggagatcgttaggggggaggctaagggcgtctgggtggtctccctggacgaggctaggctgaggctcgttccaaggcctgttgtggctgctttcccaagcggcaaggctcaggtgtacgctctgaggaccgctacgggcagggtgctggaggcgacagctaaccacccagtctacactccagagggctggaggccactggggaccctcgctcctggcgactacgtcgctctgccaaggcatctctcgtacaggccatctctgcacctggagggccatgagctggatctcctggggttcgctctggctgagggccacctccgccatccatcgggcgtgtacctctacacctccagcgaggaggagctggctgccatggaggaggctctcagggcgttccctaatacgcggatccgcgtcgtttggaggaggggggttgctcacgtctacgtgggcagggtggacaggaggcaggaggctggcgctgtggcgttcctcaggaggatgggcctcctggggctggatgcgaagacgaagaggctcccagaggctgtcttcggcctgccaccagaggaggttgctaggttcctggggaggctctggacaggcgacggcggggtggatccaaagggcaggctgattcactacgctactgctagcaaggagctcgcttggggcgtccagcatctcctgctcaggctgggcctccagagcaggctggtggagaagcggttctcgggcgggtacaagggctacgctgtctacctgctcggcgggctggaggctgctaggaggttcgctgagacagtggggccatacctggtcggcaagcggaggcaggacctggaggctctgctcgcttcatgggagaaggctggcaggtccaccggggatgttctgccactcgcgttcctggaggaggtgagggctgctgttgctgaggtggctcagggccaggtggctgacctgctcagggaggccggcctcgcggaggggctgctctgcctgggcagggggaggagggggctctctcgcgccaccgtcggcaggctggctgccctcacggggtcactggcgctgctccggctcgcggaggctgaggtttactgggatcgcgtcgaggcggttgagccgctcggcgaggaggaggtcttcgatctcactgtggagggcactcatactttcgttgcggaggatgttatcgttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3308 - DNA, 5144 bp, Artificial Sequence
  Synthetic Construct, AT-151 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctgcatccggacactctcgttcataccgatcgggggactctcaggctgcgggagctcgtggaccctttcaggcggggctggcagccgcacaccctgagcgttgctacggacgagggctggaggccatcgccagagggctacaacaatggggtggctccaaccctcagggtggtcctggagaacggcctggaggttcaggggacactcaatcataagctcaaggtgctgcgcgaggatggcactagggagtgggtcgagctccaggacctgaggccaggcgattgggtcatctgggttctggacgagcacaccggcacgccagtccagctcgctccactggatgagccactccatcctaacaccacgccaattcgcacacctgaggtgctgactgaggacctcgccttcctcctgggcttcttcttcggcgaggggttcgtgtcgggcgataggatcgggttctctgtccacgaggaggagccaatgcgggaggaggcgaagaggctgttccgggagctcttcggcctggagctgagggaggagaggaagccaggggaccgctcagttaccctggttgtgcggtcccgccctctggtgacgtggctccgcaagaacggcctcctgaaggggaaggcgagggagctggaggtcccgcgggctatcaggcagtccccaaggcctgttctcgctgcgttcctcaggggcctgttcgaggccgacggcacaattactgcggggtacccaatgctgacaactgcgagcaagcgcctcgctcaggatgtgatggtcctcctgggcgggctgggcattccttctaagctcctgaggtacaatccactcccaggccgcttctcaaaggctgagcattacggcgtccgggtcgttacggctaaggggctggagaggtacctggagcggatcggcgtgccaaaggggtcgcgcctggaggcgctgcacggcattaagccagacgtccgcagggagtccagctggccactgcctcatgctgagggcctcctgaagccactcctgaccgtgacggagaagggcaggaaggggtacgctagcccatacacaccactgcgcaaggacctcctgaggtacctgaggggcgagaggcagctcacagctactgggtacgccatggtcctggagaaggctcaggatctcggcctggaggctgagccattccccttcaacgagtactacgttagggtggcctccgtggagccgggcggggagatcctcacgctggatctctctgtggagggcaatcatacatacctcgccaatgggctcgtctctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3309 - DNA, 5051 bp, Artificial Sequence
  Synthetic Construct, AT-152 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgtggggtctactcgcattccgacggagcgggggctggttcctattgaggagctcgctagggagggggggtctttctacctggtgactgacaacagggctccgttcggcgggaggggcgctccactcccaggccacgggaccgccgtcaggaaggccgttcgggcgttcttcacgggcgtcaagccagtggtccggctgaggacaagggagggcctggaggttaccctcacgccagatcatctcctgctcacgccagagggctacagggaggctgggaagctgaggccaggcgagaagatcctcgtccagtccggcgaggggctgttcccaaaggaggagagcctgcctgctcaggctctcgctgttgtgcacgagagggtggcgacggctggcgggaggggcgggaggggcagggctgacgtccgcgcccagtacaggaacctccccacacgctggtcaagggagctgggcgttgctctcgggtggctgctcggcgacgggtacctgagggaggatggcgtcgggttctacttctcccggaaggacttcgctgatctggcctggctcccagacctgctccgcgattggttcggccctgggacactccaggagactcgcagcaacaccttccacctgcatttcaataggatcccggctgagttcttccaggctctcggcgtgaaggctgcgcgggcaactgagaagagggtcccagagtcgctgttccgggctcctcgcgaggctgtcgttggcttcctgcaggggctcttctctgcggacggctcagttcagattaacgagaataagcaggatgctaccgtgaggctggcctccagctcgctcgctctgctccaggacgtgcagctgctcctgctcaacctgggcatcctcgggaagattcacaagaggagggaggctgctaggaaggctctcccggacggcaagggcgggctgagggagtacccagtcgctcctcagtacgagctgattctcggcggggagaatagggatcggttcgccgaggtggtcggcttcctccaggaggagaagcagagcaagctgctcgcgttcctgaggcataggccgaggggctcgtacaggaagcccttcctcgctaccgttgcttctgtggagccagctggcgaggcgcccgtgtacgatctcacagagccagttacacactcgctcattgctaatgggctcgttgctcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3310 - DNA, 4388 bp, Artificial Sequence
  Synthetic Construct, AT-153 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgtttcgggggagacgccagtctacctcgctgacggcaagacaattaagatcaaggacctctactcatctgagcgcaagaaggaggacaacatcgtcgaggctggctccggggaggagatcattcacctcaaggacccgatccagatctacagctacgttgatggcacgatcgtgcgctcccgctcccgcctcctgtacaaggggaagtccagctacctggtgcgcatcgagacaattggcgggcgctcagtgtccgtcactcccgtccataagctcttcgttctgaccgagaagggcatcgaggaggttatggcctcgaatctcaaagtgggggacatgattgctgctgtcgctgagagcgagtcggaggcccgggattgcggcatgagcgaggagtgcgtgatggaggcggaggtctacacctctctggaggctacgttcgaccgcgttaagtcaatcgcgtacgagaagggcgacttcgatgtgtacgatctgtcagttccagagtacggcaggaacttcattgggggggaggggctgctcgtgctccacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3311 - DNA, 4286 bp, Artificial Sequence
  Synthetic Construct, AT-154 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctctcaggggagactgcggttatgacggtggagtacggggctattcctattcggcggctggttcaggagcggctgatctgccaggtttactcgctcgacccacagggccacctgtacacgcagcctatcgctcagtggcatttccagggcttccgcccggtgtacgcgtaccagctggaggacgggtccacaatttgcgctactccggatcaccggttcatgaccacgagcggccagatgctgcccatcgagcagattttccgcgaggggctggagctgtggcaggtggccatcgctccaccaggcgctctcgctcaggggctgaagccggccgtccagatgtcctgcatgaagattgtgggcaggaggctcgtcgggtggcaggctgtttacgatattgggctcgccggggatcataacttcctcctcgctaatggggctattgctgctaatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3312 - DNA, 4751 bp, Artificial Sequence
  Synthetic Construct, AT-155 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcgttaccgctgacacatgggttactaccgctgaggggccaaggcaggtggaggagctgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcggatttctgcgagggcatcctgagggggctcttcgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3313 - DNA, 5198 bp, Artificial Sequence
  Synthetic Construct, AT-156 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgctaaggggactgaggtcatgatgcacgacggctctgtgaaggctattgagactatcgaggcgggggaggctgttatggggaccgacggccagccaaggaaggtggtcggcctccctcgggggagggaggtcatgtacaaggtttcccagaagacggcgcaccgggtgcataagaccgacgagacgcgcgccgctccagtcgctctcttcgagtacaactgcaatgccacacacaagctggttgtgaggactcctcggagctgccgctcgatcacccgcaagatgcagggcgttgactacaacgaggtcatcttcttcgacctcaagaagaagaagctggaggacggccgcgagatcgagattgtcaaggaggtttcgaggtcttacccagctgctgagggcgctgagaaggctgctcagatggtgaaggactactacgatgccgcgcgcgggaaggagttcttcgagtggacaatcgaggcgagggatgttagggagctcggcgctcacgtgaggaaggctactcatcaggtgtacgccccagtcctgtacgagagcgacttcttcttccattacgtgaagaactcgaagttcgctctgaggtctgaggcctcaacagctctcgcctacctcctgggcctgtgggtcggcgacgggctctccgatagggctgtgctgtccgtcgacagcgaggattccagcctcctggagcgcatcactggctacgccgacattctcgatctgagcgcggagtacaaggaccgcgagatcccgaagagggcgaagaccgtctgcctctaccccaagacgatccgcggcaacgatattcgcaggaacctgaatacggacaacccggtctggaatgccatcgttgacctcggctacctgaaggatggggttaagaatgtgccctcgtacctcttctcagactccatctgccacagggaggtgttcctcgcgggcctgattgactctgatgggcatgtccggggcgacgatgggctgtcagttacaatcaagactattcacaagaccgtcatggagggcacggtggctgtcgctaggtcgctcgggctgatcgtttctgtgaacaccgaggaggcgaagattgacaagaacgatgtgaatcaccgcttcgtctacgctatctacatttcaggcggggacgctctcctgtccgtgctcgctcattgcgctgctgcgaagaagttcagggctccaccatccaatgaggtcgttcgggggctcaagaaggtcttcttcgagatggaggagctgaaggaggacgattactacggcatcacgctcgctaaggagtcagaccatcagttcctgctcgccaatcagctcgtggttcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3314 - DNA, 5180 bp, Artificial Sequence
  Synthetic Construct, AT-157 intein modified protein in pBS
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcttcgccaagggcactgaggttatgatgtcggatgggtcaattaaggaggtggagggcattgaggtcgggcaggaggtcatgggcaaggacggcaagccgcgggaggtggtcggcaccccatcggggcgcgagaagatgtacaaggtctctcacaagaccgctcacagggcccataagtccgacagcacgtcggagcggttcggcctcttcgagtacacatgcaacgccactcataagctggttgtgcgcacctctaggtcatgccggccgctcgtcaggaacatccagggcacggactacgtcgaggtttgcctcttcaatatgaccaagaagacgctggaggacggccgcgtgatcgatattgtcgaggagaccagcgatttctacccagcggtggaggggcctgagaaggctctcaggatcctgaaggagtacgctgaggccgacggcgggaaggagtacttcgagtggacaattgaggctcgcgatgtggctctcctgagcgctcaggtcaggaaggctacttaccagctgtcggcccccgtgctcctggagaacaatcacttctctcattacctcaaggactccaacagcgctgttggcaatgatacagtgcgggccctgtcctacttcctcgggctgtggatcggcgacgggatgctcaacaatgccgcgacgttctcagtcgattcccagaacgcgagcctcctgaacaggattaatgagttcgccgaggtgctcggcctgtctgcggagtacaaggactcacaggagccaaagcgggccaagaccgttaacctgtacgcgaaggctatccgcgacgagggcgtgaggaagaacctcgatacgcacaatctcctgtgggacgcgatcgtcgatctcggctacctgaaggacgattcgaagaacgttcctgggtacatttgctcggactctttccagcatcgggaggtgttcctggcgggcatcattgacagcacaggctacgtgtccgatgagaccgccacggtgaagactatcgaccagtccgtcatgacaggcactgtggctgtcgctaggtccctcgggattaacgttagcgtggacgtcgaggttgacgaggatggcgtcgatcggtcattcgtttacgccatctacatggacaggtccgatgctctcctggctgtcctggctaactgcgcttccaacaataagcagatcgaggctccaccacacggcgtgattagggagttcaataaggcttacttcgagatggaggagctggaggaggacgagtactacgggctgactctctcaaatgagtcggatcatcagttcctcctcgctaatcagctcgtcgtgcataatacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3315 - protein, 819 aa, Artificial Sequence
  Synthetic Construct, AS-146-2 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFHKKTAEWLGELATSNASTKVVPERVLNAGESAIAAFLAGYLDGDGYLTESIVELVTKSRELADGLVFLLKRLGITPWISQKTIEGSVYYRVYIMGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3316 - protein, 819 aa, Artificial Sequence
  Synthetic Construct, AS-146-4 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCFAKDTKVYYENDTLVHFESIEDMYHKYASLGREVPFDNGYAVPLETVSVYTFEPKTGEVKRTKASYIYREKVEKLAEIRLSNGYLLRITLLHPVLVFRNGLQWVPAGMINPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGIAPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEAGKALEMGDKPELPFPWTAITKYGFTDRQVANYRTRGLPKRPELKEKVVSALLKEIERLEGVANLALETIELARRLEFHEVSSVEVVDYNDWVYDLVIPETHNFIAPNGLVLHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3317 - protein, 819 aa, Artificial Sequence
  Synthetic Construct, AS-146-5 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIMPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEVRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSIVEVVDYNDWVYDLVIPETHNFIAPNGLVLHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3318 - protein, 819 aa, Artificial Sequence
  Synthetic Construct, AS-146-9 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCFAKDTKVYYENDTLVHFESIEDMYHKYASLGREVPFDNGYAVPLETVSVYTFDPKTGEVKRTKASYIYREKVEKLAEIRLSNGYLLRITLLHPVLLFRNGLQWVPAGMIKPGDLIVGIRSVPANAATIEESEAYFLGLFVAEGTSNSLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQMTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPDLKEKVVSALLKEIERLEGVAKLALETIELARRLEFHEVSSVEVVDYNDWVYDLVIPETHNFIAPNGLVLHNSNVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3319 - protein, 819 aa, Artificial Sequence
  Synthetic Construct, AS-146-11 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQSCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIKGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYYFRLRGCGNNNNLARVDLRIDGRTVGTFYYQGTYPWEAPIDNVYVSAGSHTVEITVTADNGTWDVYADYLVIQ

SEQ ID NO: 3320 - protein, 819 aa, Artificial Sequence
  Synthetic Construct, AS-146-12 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQSCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPEMVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVDDYNDWVYDLVIPETHNFIAPNGLVLHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3321 - protein, 819 aa, Artificial Sequence
  Synthetic Construct, AS-146-13 intein modified protein
MQTSITLTSNASGTFDGYYYELWKDTGNTIMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGGLATSNASTKVVPERVLNAGESAIAAFLAGYLDGDEYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRMEFHEVSSVEVVDYNDWVYDLVIPETHNFIAPNGLVLHNSTVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3322 - protein, 819 aa, Artificial Sequence
  Synthetic Construct, AS-146-16 intein modified protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCFAKDTKVYYENDTLVHFESIEDMYHKYASLGREVPFDNGYAVPLETVSVYTFDLKTGEVKRTKASYIYREKVEKLAEIRLSNGYLLRITLLHPVLVFRNGLQWVPAAMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYADGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 3323 - DNA, 2460 bp, Artificial Sequence
  Synthetic Construct, AS-146-2 intein modified protein CDS
atgcaaacaagcattactctgacatccaacgcatccggtacgtttgacggttactattacgagctctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccacaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgtggattagccagaagacaatcgaggggtcggtctactaccgggtctacattatgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtatgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3324 - DNA, 2460 bp, Artificial Sequence
  Synthetic Construct, AS-146-4 intein modified protein CDS
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgaaccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaatcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcgcgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctgggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaacctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3325 - DNA, 2460 bp, Artificial Sequence
  Synthetic Construct, AS-146-5 intein modified protein CDS
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtaccagctggcatgatcatgcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggttcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccatcgtggaggtcgttgactacaatgattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggaagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3326 - DNA, 2460 bp, Artificial Sequence
  Synthetic Construct, AS-146-9 intein modified protein CDS
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggtacaatccggatcacgtactctgcgacttacaacccaaacgggaactcctacttgtgtatctatggctggtctaccaacccattggtcgagttctatatcgttgagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggatatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcctgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaattctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagatgacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagacctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactccaatgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3327 - DNA, 2460 bp, Artificial Sequence
  Synthetic Construct, AS-146-11 intein modified protein CDS
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagtcttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcaaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactactatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3328 - DNA, 2460 bp, Artificial Sequence
  Synthetic Construct, AS-146-12 intein modified protein CDS
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagtcttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggaaaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagatggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccgaatctacattacgggcgaggatcgcaagacattcgagaaagtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgatgactacaatgattgggtctacgatctcgtcattccagagacacataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3329 - DNA, 2460 bp, Artificial Sequence
  Synthetic Construct, AS-146-13 intein modified protein CDS
atgcaaacaagcattactctgacatccaacgcatccggtacgtttgacggttactattacgaactctggaaggatactggcaatacaataatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgggctggctacttcgaacgcctctaccaaggtggtccctgagagggtcctcaatgcgggggagtccgctatcgctgccttcctcgctggctacctggacggcgatgagtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggataacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcatggagttccatgaggtttccagcgtggaggtcgttgactacaatgattgggtctacgatctcgtcattccagagactcataacttcattgctccaaatgggctcgtgctccacaactccactgtggggacagccacgttcgatcagtactggagcgtgcgcacctctaagcggacatcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttctattaccagggcacatacccctgggaggccccaattgacaatgtttatgtcagtgcagggagtcatacagtcgaaatcactgttactgcggataacggcacatgggacgtgtatgccgactacctggtgatacagtga

SEQ ID NO: 3330 - DNA, 2460 bp, Artificial Sequence
  Synthetic Construct, AS-146-16 intein modified protein CDS
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgtagagtcctgggggaactggagaccgcctggtgccacgtccctgggccaagtgacaatcgatggcgggacctacgacatctataggacgacacgcgtcaaccagccttgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatctgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctgccatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgaaaacatgtccttgtccggaccctacgttagcaggatcaccaatccctttaatggtattgcgctgtacgccgacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 3331 - DNA, 2545 bp, Artificial Sequence
  Synthetic construct,  P77853-S158_1
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagcct

SEQ ID NO: 3332 - DNA, 1285 bp, Artificial Sequence
  Synthetic construct, P77853-S158_2
tccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg

SEQ ID NO: 3333 - DNA, 2473 bp, Artificial Sequence
  Synthetic construct, P77853-T134_1
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagcatatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcc

SEQ ID NO: 3334 - DNA, 1357 bp, Artificial Sequence
  Synthetic construct P77853-T134_2
acgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtg
